United States Patent
Mitter et al.

(10) Patent No.: US 10,932,469 B2
(45) Date of Patent: Mar. 2, 2021

(54) METHOD FOR PROPAGATING MICROORGANISMS WITHIN PLANT BIOREACTORS AND STABLY STORING MICROORGANISMS WITHIN AGRICULTURAL SEEDS

(71) Applicants: INDIGO AG, INC., Boston, MA (US); AIT AUSTRIAN INSTITUTE OF TECHNOLOGY GMBH, Vienna (AT)

(72) Inventors: Birgit Mitter, Giesshubl (AT); Muhammad Naveed, Faisalabad (PK); Teresa Berninger, Vienna (AT); Stephane Compant, Vienna (AT); Angela Sessitsch, Vienna (AT); Geoffrey Von Maltzahn, Boston, CA (US); Richard Bailey Flavell, Thousand Oaks, CA (US); Gerardo V. Toledo, Belmont, MA (US); Slavica Djonovic, Malden, MA (US); Luis Miguel Marquez, Belmont, MA (US); David Morris Johnston, Cambridge, MA (US); Yves Alain Millet, Newtonville, MA (US); Jeffrey Lyford, Hollis, NH (US); Jonathan W. Leff, Cambridge, MA (US); Phillip Samayoa, Cambridge, MA (US); Craig Sadowski, Somerville, MA (US)

(73) Assignees: AIT Austrian Institute of Technology, Vienna (AT); Indigo AG, Inc., Boston, MA (US)

( * ) Notice: Subject to any disclaimer, the term of this patent is extended or adjusted under 35 U.S.C. 154(b) by 1 day.

(21) Appl. No.: 16/512,219

(22) Filed: Jul. 15, 2019

(65) Prior Publication Data
US 2020/0008431 A1    Jan. 9, 2020

Related U.S. Application Data

(63) Continuation of application No. 15/107,965, filed as application No. PCT/US2014/072400 on Dec. 24, 2014, now Pat. No. 10,362,787, and a continuation of application No. 14/315,804, filed on Jun. 26, 2014, now Pat. No. 9,364,005.

(60) Provisional application No. 61/920,560, filed on Dec. 24, 2013, provisional application No. 62/017,816, filed on Jun. 26, 2014, provisional application No. 62/017,809, filed on Jun. 26, 2014, provisional application No. 62/017,813, filed on Jun. 26, 2014, provisional application No. 62/017,796, filed on Jun. 26, 2014, provisional application No. 62/017,818, filed on Jun. 26, 2014, provisional application No. 62/017,815, filed on Jun. 26, 2014.

(30) Foreign Application Priority Data

Jun. 26, 2014  (WO) ............... PCT/US2014/044427
Sep. 4, 2014   (WO) ............... PCT/US2014/054160

(51) Int. Cl.
| A01N 63/00 | (2020.01) |
| A01N 63/10 | (2020.01) |
| A01H 5/00  | (2018.01) |
| C12N 1/20  | (2006.01) |
| G01N 33/00 | (2006.01) |

(52) U.S. Cl.
CPC ............... *A01N 63/00* (2013.01); *A01H 5/00* (2013.01); *A01N 63/10* (2020.01); *C12N 1/20* (2013.01); *G01N 33/0098* (2013.01)

(58) Field of Classification Search
None
See application file for complete search history.

(56) References Cited

U.S. PATENT DOCUMENTS

| 2,200,532 A | 5/1940 | Bond |
| 4,940,834 A | 7/1990 | Hurley et al. |
| 5,041,290 A | 8/1991 | Gindrat et al. |
| 5,113,619 A | 5/1992 | Leps et al. |
| 5,229,291 A | 7/1993 | Nielsen et al. |
| 5,292,507 A | 3/1994 | Charley |
| 5,415,672 A | 5/1995 | Fahey et al. |
| 5,730,973 A | 3/1998 | Morales et al. |
| 5,919,447 A | 7/1999 | Marrone et al. |
| 5,994,117 A | 11/1999 | Bacon et al. |
| 6,072,107 A | 6/2000 | Latch et al. |
| 6,077,505 A | 6/2000 | Parke et al. |
| 6,337,431 B1 | 1/2002 | Tricoli et al. |
| 6,495,133 B1 | 12/2002 | Xue |
| 6,602,500 B1 | 8/2003 | Kharbanda et al. |
| 6,681,186 B1 | 1/2004 | Denisov et al. |

(Continued)

FOREIGN PATENT DOCUMENTS

| CA | 1041788 | 11/1978 |
| CA | 1229497 | 11/1987 |

(Continued)

OTHER PUBLICATIONS

Kim et al. Appl Biol Chem. (2019)62:32.*

(Continued)

*Primary Examiner* — Medina A Ibrahim
(74) *Attorney, Agent, or Firm* — Goodwin Procter LLP

(57) ABSTRACT

The present invention relates to methods of scalably producing microorganisms by propagating them within plant tissues and introducing them into agricultural seeds to improve their shelf-life during long-term storage, to produce substances of interest, and to create libraries of microbes.

12 Claims, 34 Drawing Sheets
Specification includes a Sequence Listing.

(56) References Cited

U.S. PATENT DOCUMENTS

| | | |
|---|---|---|
| 6,689,880 B2 | 2/2004 | Chen et al. |
| 6,823,623 B2 | 11/2004 | Minato et al. |
| 7,037,879 B2 | 5/2006 | Imada et al. |
| 7,084,331 B2 | 8/2006 | Isawa et al. |
| 7,335,816 B2 | 2/2008 | Kraus et al. |
| 7,341,868 B2 | 3/2008 | Chopade et al. |
| 7,485,451 B2 | 2/2009 | Vandergheynst et al. |
| 7,555,990 B2 | 7/2009 | Beaujot |
| 7,632,985 B2 | 12/2009 | Malven et al. |
| 7,763,420 B2 | 7/2010 | Stritzker et al. |
| 7,906,313 B2 | 3/2011 | Henson et al. |
| 7,977,550 B2 | 7/2011 | West et al. |
| 8,143,045 B2 | 3/2012 | Miansnikov et al. |
| 8,455,198 B2 | 6/2013 | Gao et al. |
| 8,455,395 B2 | 6/2013 | Miller et al. |
| 8,465,963 B2 | 6/2013 | Rolston et al. |
| 8,728,459 B2 | 5/2014 | Isawa et al. |
| 8,975,489 B2 | 3/2015 | Craven |
| 9,049,814 B2 | 6/2015 | Marx et al. |
| 9,113,636 B2 | 8/2015 | von Maltzahn et al. |
| 9,277,751 B2 | 3/2016 | Sword |
| 9,288,995 B2 | 3/2016 | von Maltzahn et al. |
| 9,295,263 B2 | 3/2016 | von Maltzahn et al. |
| 9,364,005 B2 | 6/2016 | Mitter et al. |
| 9,408,394 B2 | 8/2016 | von Maltzahn et al. |
| 9,532,572 B2 | 1/2017 | von Maltzahn et al. |
| 9,532,573 B2 | 1/2017 | von Maltzahn et al. |
| 9,545,111 B2 | 1/2017 | Sword |
| 9,622,485 B2 | 4/2017 | von Maltzahn et al. |
| 9,652,840 B1 | 5/2017 | Shriver et al. |
| 9,687,001 B2 | 6/2017 | Vujanovic et al. |
| 9,756,865 B2 | 9/2017 | Sword |
| 10,058,101 B2 | 8/2018 | von Maltzahn et al. |
| 10,076,120 B2 | 9/2018 | von Maltzahn et al. |
| 10,104,862 B2 | 10/2018 | Vujanovic et al. |
| 10,212,912 B2 | 2/2019 | Vujanovic et al. |
| 2005/0070435 A1 | 3/2005 | Chopade et al. |
| 2005/0072047 A1 | 4/2005 | Conkling et al. |
| 2006/0046246 A1 | 3/2006 | Zeng et al. |
| 2007/0028318 A1 | 2/2007 | Livore et al. |
| 2007/0055456 A1 | 3/2007 | Raftery et al. |
| 2007/0142226 A1 | 6/2007 | Franco |
| 2007/0292953 A1 | 12/2007 | Mankin et al. |
| 2008/0229441 A1 | 9/2008 | Young et al. |
| 2008/0289060 A1 | 11/2008 | De Beuckeleer et al. |
| 2009/0155214 A1 | 6/2009 | Isawa et al. |
| 2010/0064392 A1 | 3/2010 | Yang et al. |
| 2010/0095396 A1 | 4/2010 | Voeste et al. |
| 2010/0205690 A1 | 8/2010 | Blasing et al. |
| 2010/0227357 A1 | 9/2010 | Redman et al. |
| 2011/0182862 A1 | 7/2011 | Green et al. |
| 2012/0108431 A1 | 5/2012 | Williams et al. |
| 2012/0131696 A1 | 5/2012 | Aayal et al. |
| 2012/0144533 A1 | 6/2012 | Craven |
| 2012/0149571 A1 | 6/2012 | Kloepper et al. |
| 2012/0178624 A1 | 7/2012 | Kaminskyj et al. |
| 2012/0324599 A1 | 12/2012 | Kerns et al. |
| 2013/0031673 A1 | 1/2013 | Grandlic et al. |
| 2013/0071425 A1 | 3/2013 | Vidal et al. |
| 2013/0079225 A1 | 3/2013 | Smith et al. |
| 2013/0150240 A1 | 6/2013 | Newman et al. |
| 2013/0233501 A1 | 9/2013 | Van Zyl et al. |
| 2014/0020136 A1 | 1/2014 | Van Der Wolf et al. |
| 2014/0109249 A1 | 4/2014 | Turner et al. |
| 2014/0115731 A1 | 4/2014 | Turner et al. |
| 2014/0147425 A1 | 5/2014 | Henn et al. |
| 2014/0342905 A1 | 11/2014 | Bullis et al. |
| 2015/0020239 A1 | 1/2015 | von Maltzahn et al. |
| 2015/0033420 A1 | 1/2015 | Rodriguez et al. |
| 2015/0126365 A1 | 5/2015 | Sword |
| 2015/0230478 A1 | 8/2015 | Vujanovic et al. |
| 2015/0242970 A1 | 8/2015 | Avey et al. |
| 2015/0335029 A1 | 11/2015 | Mitter et al. |
| 2015/0366217 A1 | 12/2015 | Vujanovic et al. |
| 2015/0368607 A1 | 12/2015 | Arnold et al. |
| 2015/0370935 A1 | 12/2015 | Starr |
| 2015/0373993 A1 | 12/2015 | von Maltzahn et al. |
| 2016/0021891 A1 | 1/2016 | von Maltzahn et al. |
| 2016/0150796 A1 | 6/2016 | von Maltzahn et al. |
| 2016/0174570 A1 | 6/2016 | Vujanovic et al. |
| 2016/0192662 A1 | 7/2016 | Sword |
| 2016/0205947 A1 | 7/2016 | Sword |
| 2016/0235074 A1 | 8/2016 | von Maltzahn et al. |
| 2016/0255844 A1 | 9/2016 | Mitter et al. |
| 2016/0260021 A1 | 9/2016 | Marek |
| 2016/0286821 A1 | 10/2016 | Sword |
| 2016/0290918 A1 | 10/2016 | Xu et al. |
| 2016/0316760 A1 | 11/2016 | Ambrose et al. |
| 2016/0316763 A1 | 11/2016 | Sword |
| 2016/0330976 A1 | 11/2016 | Mitter et al. |
| 2016/0338360 A1 | 11/2016 | Mitter et al. |
| 2016/0366892 A1 | 12/2016 | Ambrose et al. |
| 2017/0020138 A1 | 1/2017 | von Maltzahn et al. |
| 2017/0164619 A1 | 6/2017 | von Maltzahn et al. |
| 2017/0164620 A1 | 6/2017 | von Maltzahn et al. |
| 2017/0215358 A1 | 8/2017 | Franco et al. |
| 2017/0223967 A1 | 8/2017 | Mitter et al. |
| 2018/0020677 A1 | 1/2018 | Ambrose et al. |
| 2018/0092365 A1 | 4/2018 | Sword |
| 2018/0153174 A1 | 6/2018 | Riley et al. |
| 2018/0177196 A1 | 6/2018 | Sword |
| 2018/0213800 A1 | 8/2018 | Djonovic et al. |
| 2018/0249716 A1 | 9/2018 | Riley |
| 2018/0251776 A1 | 9/2018 | Riley |

FOREIGN PATENT DOCUMENTS

| | | |
|---|---|---|
| CA | 2562175 | 1/2013 |
| CA | 2916678 A1 | 12/2014 |
| CA | 2960032 A1 | 3/2015 |
| CA | 2935218 A1 | 7/2015 |
| CA | 2953466 A1 | 12/2015 |
| CA | 2953697 A1 | 12/2015 |
| CN | 1604732 | 4/2005 |
| CN | 101311262 A | 11/2008 |
| CN | 101423810 A | 5/2009 |
| CN | 101570738 | 11/2009 |
| CN | 101693881 A | 4/2010 |
| CN | 102168022 A | 8/2011 |
| CN | 102352327 A | 2/2012 |
| CN | 102010835 B | 4/2012 |
| CN | 102533601 B | 10/2013 |
| CN | 103642725 A | 3/2014 |
| CN | 104388356 A | 3/2015 |
| CN | 104560742 A | 4/2015 |
| EP | 0192342 | 8/1986 |
| EP | 0223662 | 5/1987 |
| EP | 0378000 | 7/1990 |
| EP | 0494802 | 7/1992 |
| EP | 0818135 | 1/1998 |
| EP | 1621632 A1 | 2/2006 |
| EP | 1935245 | 6/2008 |
| EP | 2676536 | 12/2013 |
| JP | 2009/072168 | 4/2009 |
| KR | 20100114806 A | 10/2010 |
| KR | 101066283 | 9/2011 |
| KR | 101091151 | 12/2011 |
| KR | 20130023491 | 3/2013 |
| RU | 2043028 C1 | 9/1995 |
| WO | WO 1988/009114 | 1/1988 |
| WO | WO 1994/016076 | 7/1994 |
| WO | WO 2000/029607 | 5/2000 |
| WO | 2001/083697 A2 | 11/2001 |
| WO | WO 2001/083818 | 11/2001 |
| WO | WO 2002/065836 | 8/2002 |
| WO | 2004/046357 A1 | 6/2004 |
| WO | WO 2005/003328 | 1/2005 |
| WO | WO 2007/021200 | 2/2007 |
| WO | WO 2007/107000 | 9/2007 |
| WO | WO 2008/103422 | 8/2008 |
| WO | WO 2009/012480 A2 | 1/2009 |
| WO | WO 2009/078710 A1 | 6/2009 |
| WO | WO 2009/126473 A1 | 10/2009 |
| WO | WO 2010/109436 | 9/2010 |

(56) References Cited

FOREIGN PATENT DOCUMENTS

| WO | WO 2010/115156 | 10/2010 |
|---|---|---|
| WO | WO 2011/001127 | 1/2011 |
| WO | WO 2011/082455 | 7/2011 |
| WO | WO 2011/112781 | 9/2011 |
| WO | WO 2011/117351 | 9/2011 |
| WO | WO 2012/034996 | 3/2012 |
| WO | WO 2013/016361 | 1/2013 |
| WO | WO 2013/029112 | 3/2013 |
| WO | WO 2013/090628 | 6/2013 |
| WO | WO 2013/122473 | 8/2013 |
| WO | WO 2013/177615 | 12/2013 |
| WO | WO 2013/190082 | 12/2013 |
| WO | WO 2014/046553 | 3/2014 |
| WO | WO 2014/082950 | 6/2014 |
| WO | WO 2014/121366 | 8/2014 |
| WO | WO 2014/206953 | 12/2014 |
| WO | WO 2014/210372 | 12/2014 |
| WO | WO 2015/035099 | 3/2015 |
| WO | WO 2015/069938 | 5/2015 |
| WO | WO 2015/100431 | 7/2015 |
| WO | WO 2015/100432 | 7/2015 |
| WO | 2015/192172 A1 | 12/2015 |
| WO | WO 2015/200852 | 12/2015 |
| WO | WO 2015/200902 | 12/2015 |
| WO | 2016/057991 A1 | 4/2016 |
| WO | 2016/090212 A1 | 6/2016 |
| WO | WO 2016/109758 | 7/2016 |
| WO | WO 2016/179046 | 11/2016 |
| WO | WO 2016/179047 | 11/2016 |
| WO | WO 2016/200987 | 12/2016 |
| WO | 2018102733 A1 | 6/2018 |
| WO | 2018160244 A1 | 9/2018 |
| WO | 2018160245 A1 | 9/2018 |

OTHER PUBLICATIONS

Halligan et al. Gene (1995) 161:217-222.*
Arend et al.Phytochemistry (2000) 53:187-193.*
Engev et al (Nature Reviews: Molecular Cell Biology (2015) 16:30-44.*
Bais et al. Annual Review. Plant Biol. (2006)57:233-266.*
Goepfert et al. Plant Physiology (2005) 138:1947-1956.*
Abello, J., et al., "Agrobacterium-mediated transformation of the endophytic fungus *Acremonium implicatum* associated with Brachiaria grasses", Mycological Research, pp. 407-413, vol. 112, Pt 3.
Antony-Badu, S., et al., "Multiple *Streptomyces* species with distinct secondary metabolomes have identical 16S rRna gene sequences." Scientific Reports 7.1, Sep. 2017, No. 7, 11089, pp. 1-8.
Bandara, WM.M.S., et al., "Interactions among endophytic bacteria and fungi: effects and potentials" Journal of Biosciences, Dec. 2006, vol. 31, No. 5, pp. 645-650.
Bragantia, et al, "Identificaqao e Avaliaqao de Rizobacterias Isoladas de Raizes de Milho," Jan. 1, 2010, pp. 905-911, Retrieved from the Internet: URL:http://www.scielo.br/pdf/brag/v69n4/v69n4a17.pdf (With English Abstract).
Fox, G., et al., "How close is close: 16S rRNA sequence identity may not be sufficient to guarantee species identity." International Journal of Systematic and Evolutionary Microbiology 42.1, 1992, pp. 166-170.
NCBI, GenBankAccession No. XP_002568042, Aug. 14, 2009, 4 Pages, Berg, V.D., et al., "Genome sequencing and analysis of the filamentous fungus," Nat. Biotechnol. 26 (10), 1161-1168 (2008).
Hain, T., et al., "Chitinolytic transgenes from Streptomyces albidoflavus as phytochemicals defences against; herbivorous insects, use in transgenic plants and effect in plant development", International Journal of Systematic Bacteriology, Jan. 1997, vol. 47, No. 1, pp. 202-206.
Hjort, K., et al., "Chitinase genes revealed and compared in bacterial isolates, DNA extracts and a metagenomic library from a phytopathogen-suppressive soil", FEMS Microbiology Ecology, Feb. 2010, vol. 71, No. 2, pp. 197-207.

Kanbar, A., et al., "Relationship between Root and Yield Morphological Characters in Rainfed Low Land Rice (*Oryza sativa* L.)," Cereal Research Communications, 2009, vol. 37, No. 2, pp. 261-268.
Li, M. et al., "ATP Modulates the Growth of Specific Microbial Strains", Current Microbiology, May 30, 2010, vol. 62, No. 1, pp. 84-89.
Ogbo, F., et al., "Some Characteristics of a Plant Growth Promoting; iEnterobacter/isp. Isolated from the Roots of Maize", Advances in Microbiology, Jan. 1, 2012, vol. 02, No. 03, pp. 368-374.
Partida-Martinez, L.P., et al., "Endosymbiont-Dependent Host Reproduction Maintains Bacterial-Fungal Mutualism", Current Biology, May 1, 2007, vol. 17, No. 9, pp. 773-777.
Schneider, C., et al., "Endophytes for plant protection: the state of the art Proceedings," DPG Spectrum Phytomedizin, Proceedings of the 5th International Symposium on Plant Protection and Plant Health in Europe, May 26-29, 2013, 347 Pages.
Sharma et al., "Detection and identification of bacteria intimately associated with fungi of the order Sebacinales", Cellular Microbiology, Aug. 5, 2008, pp. 2235-2246, vol. 10, No. 11.
United States Patent Office, Non-Final Office Action, U.S. Appl. No. 14/916,514, dated Sep. 20, 2017, 31 Pages.
United States Patent Office, Non-Final Office Action, U.S. Appl. No. 15/143,398, dated Sep. 22, 2017, 16 Pages.
United States Patent Office, Non-Final Office Action, U.S. Appl. No. 15/143,394, dated Sep. 25, 2017, 15 Pages.
PCT International Search Report and Wlitten Opinion, PCT Application No. PCT/US2015/068206, dated Jun. 27, 2016, 20 Pages.
PCT International Search Report and Wrrtten Opinion, PCT Application No. PCT/US2016/030292, dated Aug. 12, 2016, 20 Pages.
PCT International Search Report and Wrrtten Opinion, PCT Application No. PCT/US2016/030293, dated Aug. 11, 2016, 23 Pages.
PCT International Search Report and Wlitten Opinion, PCT Application No. PCT/US2016/036504, dated Nov. 4, 2016, 18 Pages.
United States Patent Office, Non-Final Office Action, U.S. Appl. No. 14/964,429, dated Aug. 9, 2016, 6 Pages.
United States Patent Office, Final Office Action, U.S. Appl. No. 14/964,429, dated May 31, 2017, 9 Pages.
United States Patent Office, Non-Final Office Action, U.S. Appl. No. 15/063,350, dated Nov. 10, 2016, 18 Pages.
United States Patent Office, Final Office Action, U.S. Appl. No. 14/614,193, dated Dec. 22, 2016, 13 Pages.
United States Patent Office, Non-Final Office Action, U.S. Appl. No. 15/107,973, dated Apr. 10, 2017, 39 Pages.
United States Patent Office, Final Office Action, U.S. Appl. No. 14/410,537, dated May 5, 2017, 9 Pages.
United States Patent Office, Non-Final Office Action, U.S. Appl. No. 15/034,862, dated May 19, 2017, 8 Pages.
United States Patent Office, Non-Final Office Action, U.S. Appl. No. 14/766,065, dated Oct. 27, 2017, 11 Pages.
United States Patent Office, Non-Final Office Action, U.S. Appl. No. 15/212,038, dated Sep. 21, 2016, 10 Pages.
United States Patent Office, Final Office Action, U.S. Appl. No. 14/614,193, dated Jul. 18, 2017, 14 Pages.
United States Patent Office, Final Office Action, U.S. Appl. No. 14/614,193, dated May 3, 2018, 10 Pages.
United States Patent Office, Final Office Action, U.S. Appl. No. 15/107,973, dated Jan. 26, 2018, 20 Pages.
United States Patent Office, Final Office Action, U.S. Appl. No. 15/034,862, dated Jan. 12, 2018, 14 Pages.
United States Patent Office, Non-Final Office Action, U.S. Appl. No. 15/436,592, dated Aug. 30, 2017, 17 Pages.
United States Patent Office, Non-Final Office Action, U.S. Appl. No. 15/436,609, dated Aug. 30, 2017, 21 Pages.
United States Patent Office, Non-Final Office Action, U.S. Appl. No. 15/143,398, dated Sep. 22, 2017, 17 Pages.
United States Patent Office, Non-Final Office Action, U.S. Appl. No. 15/107,965, dated Jun. 21, 2018, 27 Pages.
Al-Askar AA, "Microbiological studies on the in vitro inhibitory effect of Streptomyces collinus albescens against some phytopathogenic fungi", African Journal of Microbiology Research, 2012, 6: 3277-3283 & GenBank Accession No. AB184101, May 20, 2008.

(56) References Cited

OTHER PUBLICATIONS

Ardakani, M.R. et al., "Absorption of N, P, K thorugh triple inoculation of wheat (*Triticum aestivum* L.) by Azospirillum brasilense, *Streptomyces* sp., Glomus intraradices and manure application," Physiol Mol Biol Plants, 2011, vol. 17, No. 2, pp. 181-192.
Barnett, S., et al., "Selection of microbes for control of Rhizoctonia root rot on wheat using a high throughput pathosystem", Biological Control, Jul. 6, 2017, 113: 45-57.
Bashan, Yoav Ed, et al., "Inoculants of plant growth-promoting bacteria for use in agriculture," Biotechnology Advances, Elsevier Publishing, Barking, GB, vol. 16, No. 4, Jul. 1, 1998, pp. 729-770, XP004123985.
Bashan, Yoav E., et al., "Alginate Beads as Synthetic Inoculant Carriers for Slow Release of Bacteria that Affect Plant Growth," Applied and Environmental Microbiology, pp. 1089-1098, May 1986.
Chenhua Li, et al., "Change in deep soil microbial communities due to long-term fertilization," Soil Biology and Biochemistry, vol. 75, Mar. 5, 2014, pp. 264-272, XP055530941.
Cheow, W.S., et al., "Biofilm-like Lactobacillus rhamnosus Probiotices Encapsulated in Algiinate and Carrageenan Microcapsules Exhibiting Enhanced Thermotolerance and Freeze-drying Resistance," Biomacromolecules 2013, vol. 14(9):3214-3222.
De Santi, M. et al., "A combined morphologic and molecular approach for characterizing fungal microflora from a traditional Italian cheese (Fossa cheese)," Inter. Dairy J., 2010, vol. 10, No. 7, pp. 465-471.
De Medeiros, L., et al., "Evaluation of Herbicidal Potential of Depsides from *Cladosporium uredinicola* an Endophytic Fungus found in Guava Fruit," J. Braz. Chem. Soc., 2012, vol. 23, No. 8, p. 1551-1557.
Fatima Z et al, "Antifungal activity of plant growth-promoting rhizobacteria isolates against Rhizoctonia solani in wheat", African Journal of Biotechnology, 2009, 8: 219-225.
GenBank Accession No. KY643705, Feb. 27, 2017.
GenBank Accession No. KF951483, Jan. 5, 2014.
PCT International Search Report and Written Opinion for PCT/US2017/064361, dated May 11, 2018, 22 Pages.
PCT International Search Report and Written Opinion, PCT Application No. PCT/US2017/064292, dated May 11, 2018, 20 Pages.
Canadian Patent Office, Office Action, Canadian Patent Application No. 2,935,218, dated May 8, 2018, 5 Pages.
Canadian Patent Office, Office Action, Canadian Patent Application No. CA 2,972,904, dated Jul. 25, 2018, 5 Pages.
European Patent Office, Extended European Search Report, European Patent Application No. EP 15876324.3, dated Jun. 12, 2018, 9 Pages.
European Patent Office, Communication Pursuant to Article 94(3) EPC for European Patent Application No. EP 14777213.1, dated Jun. 18, 2018, 4 Pages.
Intellectual Property Australia, Examination Report No. 2 for Australian Patent Application No. AU 2014315191, dated Jul. 6, 2018, 3 Pages.
Intellectual Property Australia, Examination Report No. 2 for Australian Patent Application No. AU 2015279600, dated Jul. 6, 2018, 3 Pages.
Intellectual Property Australia, Examination Report No. 1 for Australian Patent Application No. AU 2017210482, dated May 15, 2018, 4 Pages.
New Zealand Intellectual Property Office, Further Examination Report, New Zealand Patent Application No. 727449, dated Jun. 15, 2018, 5 Pages.
New Zealand Intellectual Property Office, Further Examination Report, New Zealand Patent Application No. 734085, dated Jun. 27, 2018, 6 Pages.
Russian Patent Office, Office Action for Russian Patent Application No. RU 2017141758, dated Apr. 17, 2018, 4 Pages (with Concise Explanation of Relevance).
Russian Patent Office, Office Action for Russian Patent Application No. RU 2017141632, dated Apr. 17, 2018, 4 Pages (with Concise Explanation of Relevance).
Office Action for Israel Patent Application No. IL 245385, dated Apr. 23, 2018, 3 Pages (With Concise Explanation of Relevance).
Office Action for Mexican Patent Application No. MX/a/2015/010142, dated May 29, 2018, 5 Pages (With Concise Explanation of Relevance).
Artursson, V., et al., "Interactions between *Arbuscular mycorrhizal* fungi and bacteria and their potential for stimulating plant growth", Environmental Microbiology, vol. 8, No. 1, Jan. 1, 2006, pp. 1-10.
Aveskamp, M., et al., "DNA phylogeny reveals polyphyly of Phoma section Peyronellaea and multiple taxonomic novelties," Mycologia, 2009, vol. 101, No. 3, pp. 363-382.
Azcon, R., et al., "Selective interactions between different species of *mycorrhizal* fungi and Rhizobium meliloti strains, and their effects on growth, N2-fixation (15N) and nutrition of *Medicago sativa* L.," New PhytoL., 1991, vol. 117, pp. 399-404.
Bing, La, et al., "Suppression of Ostrinia nubilalis (Hübner) (Lepidoptera: Pyralidae) by endophytic Beauveria bassiana (Balsamo) Vuillemin", Environmental Entomol, Entomological Society of America, College Park, MD, US, vol. 20, Jan. 1, 1991, pp. 1207-1211.
Compant, S., et al., "Endophytic colonization of *Vitis vinfera* L. by Burkholderia phytofirmans strain PsJN: from the rhizosphere to inflorescence tissues," FEMS Microbiol Ecol, 2008, pp. 84-93, vol. 63.
NCBI GenBank: Accession No. JX880250.1, "Enterobacteriaceae bacterium Clero1 16S ribosomal RNA gene, partial sequence," NIH, Jun. 24, 2015, 2 Pages, can be retreived at <URL: https://www.ncbi.nlm.nih.gov/nucleotide/JX880250.1?report=genbank&log$=nuclalign&blast_rank=80&RID=KWUPBV08015>.
NCBI, GenBank Accession No. KX641980.1, Jul. 29, 2017, 2, Pages, Scott, M., et al., "*Dothideomycetes* sp. isolate FT14-6 internal transcribed spacer 1, partial sequence; 5.8S ribosomal RNA gene and internal transcribed spacer 2, complete sequence; and large subunit ribosomal RNA gene, partial sequence," [Online] Can be retrieved at <URL: https://www.ncbi.nlm.nih.gov/nuccore/KX641980>.
Database EMBL [Online] Oct. 1, 2001, 2 Pages, "Setosphaeria monoceras 28S ribosomal RNA gene, partial sequence," XP002777918, retrieved from EBI accession No. EM_STD:AY016368 Database accession No. AY016368 sequence.
Hubbard, M., et al., 2011. "Agricultural Potential of Fungal Endophytes of Grasses, Cereals and Wheat," In: Wheat: Genetics, Crops and Food Production. Nova Science Publishers Hauppauge, NY, USA. pp. 333-345.
Impullitti, A.E., et al., "Fungal endophyte diversity in soybean", Journal of Applied Microbiolog, vol. 114, No. 5, May 1, 2013, pp. 1500-1506.
Liu, Y., et al., "Phylogenetic relationships among ascomycetes: evidence from an RNA polymerase II subunit," Mol. Biol. Evol. 1999. vol. 16, No. 12, pp. 1799-1808.
Miyoshi-Akiyama, T., et al., "Multilocus Sequence Typing (MLST) for Characterization of Enterobacter cloacae," PLoS ONE, 2013, vol. 8, No. 6, 10 Pages, e66358.
Nassar, A., et al., "Promotion of plant growth by an auxin-producing isolate of the yeast *Williopsis saturnus* endophytic in maize (*Zea mays* L.) roots", Biology and Fertility of Soils; Cooperating Journal of International Society of Soil Science, Springer, Berlin, DE, vol. 42, No. 2, Nov. 1, 2005, pp. 97-108.
O'Hanlon, K., et al., "Exploring the potential of symbiotic fungal endophytes in cereal disease suppression", Biological Control, vol. 63, No. 2, Sep. 5, 2012, pp. 69-78.
Riess, K., et al., "High genetic diversity at the regional scale and possible speciation in *Sebacina epigaea* and *S. incrustans*," BMC Evolutionary Biology, 2013, vol. 13, No. 102, 17 Pages.
Sarkar, S., et al., "New report of additional enterobacterial species causing wilt in West Bengal, India," Canadian Journal of Microbiology, 2015, vol. 61, No. 7, pp. 477-486.
Stielow, J.B., et al., "One fungus, which genes? Development and assessment of universal primers for potential secondary fungal

(56) References Cited

OTHER PUBLICATIONS

DNA barcodes," Persoonia: Molecular Phylogeny and Evolution of Fungi, 2015, vol. 35, pp. 242-263.
Vujanovic, V., et al., "A comparative study of endophytic mycobiota in leaves of Acer saccharum in eastern North America," Mycological Progress, May 2002, pp. 147-154, vol. 1, Issue 2.
Vujanovic, V., et al.,"Orchid seed viability testing by fungal bioassays and molecular phylogeny," Floriculture, ornamental and plant biotechnology, 2006, vol. 63, pp. 563-569.
Vujanovic, V., et al., "19th International Conference on *Arabidopsis*. Research Proceedings—ICAR13," Jul. 23-27, 2008, 264 Pages, Montreal, QC, Canada.
Vujanovic, V., et al., "Mycovitality and mycoheterotrophy: where lies dormancy in terrestrial orchid and plants with minute seeds?" Symbiosis, 2007, vol. 44, pp. 93-99.
Vujanovic, V., et al: "Fungal communities associated with durum wheat production system: A characterization by growth stage, plant organ and preceding crop", Crop Protection, Elsevier Science, GB, vol. 37, Feb. 19, 2012, pp. 26-34.
Zhang, Y., et al., "BcGsl, a glycoprotein from Botrytis cinerea, elicits defence response and improves disease resistance in host plants. Biochemical and biophysical research communications," Biochemical and Biophysical Research Communications, 2015, vol. 457, No. 4, pp. 627-634.
Zhang, W., et al., Host range of *Exserohilum monoceras*, a potential bioherbicide for the control of *Echinochloa* species, Canadian Journal of Botany/ Journal Canadien de Botan, National Research Council, Ottawa, CA, vol. 75, Jan. 1, 1997, pp. 685-692.
Zhu et al., Helminthosporium velutinum and *H. aquaticum* sp. nov. from aquatic habitats in Yunnan Province, China. Phytotaxa, 2016, vol. 253, No. 3, pp. 179-190.
PCT Invitation to Pay Additional Fees, PCT Application No. PCT/CA2013/000091, dated Mar. 27, 2013, 2 Pages.
PCT International Search Report and Written Opinion for PCT/CA2013/000091, dated Sep. 20, 2013, 17 Pages.
PCT International Search Report and Written Opinion for PCT/EP2013/062976, dated Dec. 22, 2014, 9 Pages.
PCT International Search Report, Application No. PCT/US2014/044427, dated Dec. 3, 2014, 9 Pages.
PCT International Search Report and Written Opinion, Application No. PCT/US2014/054160, dated Dec. 9, 2014, 21 Pages.
PCT Invitation to Pay Additional Fees, PCT Application No. PCT/US2014/064411, dated Feb. 5, 2015, 2 Pages.
PCT International Search Report and Written Opinion, International Application No. PCT/US2014/064411, dated Mar. 27, 2015, 15 Pages.
PCT Invitation to Pay Additional Fees, PCT Application No. PCT/US2014/072399, dated Apr. 14, 2015, 2 Pages.
PCT International Search Report and Written Opinion, International Application No. PCT/US2014/072399, dated Jun. 26, 2015, 22 Pages.
PCT Invitation to Pay Additional Fees, PCT Application No. PCT/US2014/072400, dated Apr. 16, 2015, 6 Pages.
PCT International Search Report and Written Opinion, Application No. PCT/US2014/072400, dated Jul. 8, 2015, 38 Pages.
PCT International Search Report and Written Opinion, Application No. PCT/AU2014/000360, dated Aug. 5, 2015, 12 Pages.
PCT Invitation to Pay Additional Fees, PCT Application No. PCT/US2015/038110, dated Sep. 22, 2015, 8 Pages.
PCT Invitation to Pay Additional Fees, PCT Application No. PCT/US2015/038187, dated Oct. 14, 2015, 5 Pages.
PCT International Search Report and Written Opinion, PCT Application No. PCT/US2015/038110, dated Dec. 11, 2015, 36 Pages.
PCT International Search Report and Written Opinion, PCT Application No. PCT/US2015/038187, dated Jan. 22, 2016, 36 Pages.
PCT Invitation to Pay Additional Fees, PCT Application No. PCT/US2015/068206, dated Apr. 12, 2016, 5 Pages.
PCT International Search Report and Written Opinion, PCT Application No. PCT/US2015/068206, dated Jun. 27, 2016, 20 Pages.
PCT International Search Report and Written Opinion, PCT Application No. PCT/US2016/030292, dated Aug. 12, 2016, 20 Pages.
PCT International Preliminary Report on Patentability, PCT Application No. PCT/US2016/030292, dated Aug. 2, 2017, 23 Pages.
PCT International Search Report and Written Opinion, PCT Application No. PCT/US2016/030293, dated Aug. 11, 2016, 23 Pages.
PCT International Search Report and Written Opinion, PCT Application No. PCT/US2016/036504, dated Nov. 4, 2016, 18 Pages.
PCT International Search Report and Written Opinion, PCT Application No. PCT/US2016/039191, dated Nov. 29, 2016, 20 Pages.
PCT International Search Report and Written Opinion, PCT Application No. PCT/US2016/068144, dated May 18, 2017, 30 Pages.
Canadian Patent Office, Office Action, Canadian Patent Application No. 2,916,678, dated Feb. 8, 2017, 8 Pages.
Canadian Patent Office, Office Action, Canadian Patent Application No. 2,935,218, dated Jun. 13, 2017, 5 Pages.
Chinese Patent Office, Office Action, Chinese Patent Application No. 201480072142.7, Apr. 25, 2017, 14 Pages (with English translation).
European Patent Office, Supplementary Partial European Search Report, European Patent Application No. 13874703.5, dated Jun. 21, 2016, 3 Pages.
European Patent Office, Supplementary European Search Report, European Patent Application No. 13874703.5, dated Oct. 21, 2016, 16 Pages.
European Patent Office, Supplementary European Search Report, European Patent Application No. 14860187.5, dated May 24, 2017, 9 Pages.
European Patent Office, Supplementary European Search Report, European Patent Application No. 14874589.6, dated Jul. 11, 2017, 9 Pages.
European Patent Office, Examination Report, European Patent Application No. 14748326.7, dated Jul. 19, 2017, 4 Pages.
Intellectual Property Australia, Examination Report for Australian Patent Application No. 2016202480, dated Apr. 28, 2016, 2 Pages.
Intellectual Property Australia, Examination Report for Australian Patent Application No. 2014346664, dated Nov. 24, 2016, 3 Pages.
Intellectual Property Australia, Examination Report for Australian Patent Application No. 2014315191, dated Jul. 15, 2017, 6 Pages.
Intellectual Property Australia, Examination Report for Australian Patent Application No. 2015279600, dated Jul. 21, 2017, 7 Pages.
Intellectual Property Australia, Examination Report for Australian Patent Application No. 2015278238, dated Jul. 24, 2017, 3 Pages.
New Zealand Intellectual Property Office, First Examination Report, New Zealand Patent Application No. 715728, dated May 10, 2016, 4 Pages.
New Zealand Intellectual Property Office, First Examination Report, New Zealand Patent Application No. 715728, dated Dec. 5, 2016, 3 Pages.
New Zealand Intellectual Property Office, First Examination Report, New Zealand Patent Application No. 727449, dated Jun. 8, 2017, 7 Pages.
New Zealand Intellectual Property Office, First Examination Report, New Zealand Patent Application No. 726116, dated Jun. 29, 2017, 2 Pages.
New Zealand Intellectual Property Office, Second Examination Report, New Zealand Patent Application No. 726116, dated Sep. 26, 2017, 5 Pages.
New Zealand Intellectual Property Office, First Examination Report, New Zealand Patent Application No. 728495, dated Jul. 12, 2017, 5 Pages.
Russian Patent Office, Office Action for Russian Patent Application No. 2015137613, dated Jun. 7, 2017, 14 Pages (with English translation).
Ukraine Patent Office, Office Action for Ukrainian Patent Application No. a201508515, dated May 19, 2017, 14 Pages (with English translation).
Abarenkov, K., et al., "PlutoF—A Web Based Workbench for Ecological and Taxonomic Research, with an Online Implementation for Fungal ITS Sequences," Evol Bioinform Online, 2010, pp. 189-196, vol. 6.

(56) References Cited

OTHER PUBLICATIONS

Abarenkov, K., et al., "The UNITE Database for Molecular Identification of Fungi—Recent Updates and Future Perspectives," New Phytol., 2010, pp. 281-285, vol. 186.
Abdellatif, L., et al., "Endophytic hyphal compartmentalization is required for successful symbiotic Ascomycota association with root cells," Mycological Research, 2009, pp. 782-791, vol. 113.
Ahmad, F., et al., "Screening of Free-Living Rhizospheric Bacteria for Their Multiple Plant Growth Promoting Activities," Microbiol Res., 2008, pp. 173-181, vol. 163.
Amann, R., et al., "The Identification of Microorganisms by Fluorescence in Situ Hybridisation," Curr Opin Biotechnol., 2001, pp. 231-236, vol. 12.
Apel, K., et al., "Reactive Oxygen Species: Metabolism, Oxidative Stress, and Signal Transduction," Annu Rev Plant Biol., 2004, pp. 373-399, vol. 55.
Arendt, K. R., et al., "Isolation of endohyphal bacteria from foliar Ascomycota and in vitro establishment of their symbiotic associations," Appl. Environ. Microbiol., 2016, pp. 2943-2949, vol. 82, No. 10.
Ashrafuzzaman, M., et al., "Efficiency of plant growth-promoting rhizobacteria (PGPR) for the enhancement of rice growth," African Journal of Biotechnology, 2009, pp. 1247-1252, vol. 8, No. 7.
Bacon, C. W., et al., "Isolation, In Planta Detection, and Uses of Endophytic Bacteria for Plant Protection," Manual of Environmental Microbiology, 2007, pp. 638-647.
Baker, K. F., et al., "Dynamics of Seed Transmission of Plant Pathogens," Annu Rev Phytopathol., 1966, pp. 311-334, vol. 4.
Baltruschat, H., et al., "Salt tolerance of barley induced by the root endophyte *Piriformospora indica* is associated with a strong increase in antioxidants," New Phytologist., 2008, pp. 501-510, vol. 180.
Block, C. C., et al., "Seed Transmission of Pantoea stewartii in Field and Sweet Corn," Plant Disease, 1998, pp. 775-780, vol. 82.
Brinkmeyer, R., et al., "Uncultured Bacterium Clone ARKMP-100 16S Ribosomal RNA Gene, Partial Sequence," NCBI GenBank Accession No. AF468334, Submitted Jan. 14, 2002.
Brodie, E.L., et al., "Uncultured Bacterium Clone BANW722 16S Ribosomal RNA Gene, Partial Sequence," NCBI GenBank Accession No. DQ264636, Submitted Oct. 25, 2005.
Bulgarelli, D., et al., "Structure and Functions of the Bacterial Microbiota of Plants," Annu Rev Plant Biol., 2013, pp. 807-838, vol. 64.
Buttner, D., et al., "Regulation and secretion of Xanthomonas virulence factors," FEMS Microbiology Reviews, 2010, pp. 107-133, vol. 34, No. 2.
Caporaso, J.G., et al., "Ultra-High-Throughput Microbial Community Analysis on the Illumina HiSeq and MiSeq Platforms," ISME J., 2012, pp. 1621-1624, vol. 6.
Castillo, D., et al., "Fungal Entomopathogenic Endophytes: Negative Effects on Cotton Aphid Reproduction in Greenhouse and Field Conditions," Power Point Presentation dated Mar. 23, 2013.
Castillo, D., et al., "Fungal Endophytes: Plant Protective Agents Against Herbivores," Power Point Presentation dated Aug. 4, 2013.
Cavalier-Smith, T., "A Revised Six-Kingdom System of Life," Biol Rev Camb Philos Soc., 1998, pp. 203-266, vol. 73.
Cha, C., et al., "Production of Acyl-Homoserine Lactone Quorum-Sensing Signals by Gram-Negative Plant Associated Bacteria," Mol Plant Microbe Interact., 1998, pp. 1119-1129, vol. 11, No. 11.
Chernin, L. S., et al., "Chitinolytic Activity in Chromobacterium violaceum: Substrate Analysis and Regulation by Quorum Sensing," J Bacteriol., 1998, pp. 4435-4441, vol. 180, No. 17.
Clark, E. M., et al., "Improved Histochemical Techniques for the Detection of Acremonium coenophilum in Tall Fescue and Methods of in vitro Culture of the Fungus," J. Microbiol Methods, 1983, pp. 149-155, vol. 1.
Clay, K., "Effects of fungal endophytes on the seed and seedling biology of Lolium perenne and Festuca arundinacea," Oecologia, 1987, pp. 358-362, vol. 73.
Clough, S. J., et al., "Floral Dip: A Simplified Method for Agrobacterium-mediated Transformation of *Arabidopsis thaliana*," Plant J., 1998, pp. 735-743, vol. 16, No. 6.
Compant, S., et al., "Endophytes of Grapevines Flowers, Berries, and Seeds: Identification of Cultivable Bacteria, Comparison with Other Plant Parts, and Visualization of Niches of Colonization," Microbial Ecology, 2011, pp. 188-197, vol. 62.
Coombs, J. T., et al., "Isolation and Identification of Actinobacteria from Surface-Sterilized Wheat Roots," Applied and Environmental Microbiology, 2003, pp. 5603-5608, vol. 69, No. 9.
Conn, V. M., "Effect of Microbial Inoculants on the Indigenous Actinobacterial Endophyte Population in the Roots of Wheats as Determined by Terminal Restriction Fragment Length Polymorphism," Applied and Environmental Microbiology, 2004, pp. 6407-6413, vol. 70, No. 11.
Cottyn, B., et al., "Phenotypic and genetic diversity of rice seed-associated bacteria and their role in pathogenicity and biological control," Journal of Applied Microbiology, 2009, pp. 885-897, vol. 107.
Cox, C. D., "Deferration of Laboratory Media and Assays for Ferric and Ferrous Ions," Methods Enzymol., 1994, pp. 315-329, vol. 235.
Craine, J. M., et al., "Global Diversity of Drought Tolerance and Grassland Climate-Change Resilience," Nature Climate Change, 2013, pp. 63-67, vol. 3.
Dalal, J.M., et al., "Utilization of Endophytic Microbes for Induction of Systemic Resistance (ISR) in Soybean (*Glycine max* (L) Merril) Against Challenge Inoculation with R. solani," Journal of Applied Science and Research, 2014, pp. 70-84, vol. 2, No. 5.
Danhorn, T., et al., "Biofilm Formation by Plant-Associated Bacteria," Annu Rev Microbiol., 2007, pp. 401-422, vol. 61.
Daniels, R., et al., "Quorum Signal Molecules as Biosurfactants Affecting Swarming in Rhizobium etli," PNAS, 2006, pp. 14965-14970, vol. 103, No. 40.
Darsonval, A., et al., "Adhesion and Fitness in the Bean Phyllosphere and Transmission to Seed of *Xanthomonas fuscans* subsp. *fuscans*," Molecular Plant-Microbe Interactions, 2009, pp. 747-757, vol. 22, No. 6.
Darsonval, A., et al., "The Type III Secretion System of *Xanthomonas fuscans* subsp. *fuscans* is involved in the Phyllosphere Colonization Process and in Transmission to Seeds of Susceptible Beans," Applied and Envioronmental Mirobiology, 2008, pp. 2669-2678, vol. 74, No. 9.
De Freitas, J. R., et al., "Phosphate-Solubilizing Rhizobacteria Enhance the Growth and Yield but not Phosphorus Uptake of Canola (*Brassica napus* L.)," Biol Fertil Soils, 1997, pp. 358-364, vol. 24.
De Lima Favaro, L. C., et al., "*Epicoccum nigrum* P16, a Sugarcane Endophyte, Produces Antifungal Compounds and Induces Root Growth," PLoS One, 2012, pp. 1-10, vol. 7, No. 6.
De Melo Pereira, G. V., et al. "A Multiphasic Approach for the Identification of Endophytic Bacterial in Strawberry Fruit and their Potential for Plant Growth Promotion," Microbial Ecology, 2012, pp. 405-417, vol. 63, No. 2.
De Souza, J. J., et al., "Terpenoids from Endophytic Fungi," Molecules, 2011, pp. 10604-10618, vol. 16, No. 12.
Dennis, C., et al., "Antagonistic Properties of Species Groups of *Trichoderma*," Trans Brit Mycol Soc, 1971, pp. 25-39, vol. 57, No. 1.
Desiro, A., et al., "Detection of a novel intracellular microbiome hosted in arbuscular mycorrhizal fungi," ISME Journal, 2014, pp. 257-270, vol. 8.
Djordjevic, D., et al., "Microtiter Plate Assay for Assessment of Listeria monocytogenes Biofilm Formation," Annl Environ Microbiol., 2002, pp. 2950-2958, vol. 68, No. 6.
Don, R. H., et al., "Properties of Six Pesticide Degradation Plasmids Isolated From Alcaligenes Paradoxus and Alcaligenes eutrophus," J Bacteriol., 1981, pp. 681-686, vol. 145, No. 2.
Dunbar, J, et al., "Uncultured Bacterium Clone NT42a2_20488 16S Ribosomal RNA Gene, Partial Sequence," NCBI GenBank Accession No. JQ378705. Submitted Nov. 8, 2012.
Eberhard, A., et al., "Structural Identification of Autoinducer of Photobacterium fischeri Luciferase," Biochem., 1981, pp. 2444-2449, vol. 20.

(56) References Cited

OTHER PUBLICATIONS

Edgar, R. C., "Search and Clustering Orders of Magnitude Faster than BLAST," Bioinformatics, 2010, pp. 2460-2461, vol. 26, No. 19.

Edgar, R. C., "UPARSE: Highly Accurate OTU Sequences From Microbial Amplicon Reads," Nat Methods, 2013, pp. 996-998, vol. 10, No. 10.

Ek-Ramos, M. J., "Ecology, Distribution and Benefits of Fungal Endophytes Isolated from Cultivated Cotton (*Gossypium hirsutum*) in Texas," Power Point Presentation dated Nov. 7, 2012.

Ek-Ramos, M. J., et al., "Spatial and Temporal Variation in Fungal Endophyte Communities Isolated from Cultivated Cotton (*Gossypium hirsutum*)," PLoS ONE, 2013, vol. 8, No. 6, 13 Pages.

Ek-Ramos, M. J., et al., "Spatial and Temporal Variation in Fungal Endophyte Communities Isolated from Cultivated Cotton (*Gossypium hirsutum*)," Power Point Presentation dated Jan. 7, 2013.

El-Shanshoury, A. R., "Growth Promotion of Wheat Seedlings by Streptomyces atroolivaceus," Journal of Agronomy and Crop Science, 1989, pp. 109-114, vol. 163.

Emerson, D., et al., Identifying and Characterizing Bacteria in an Era of Genomics and Proteomics, BioScience, 2008, pp. 925-936, vol. 58, No. 10.

Endre, G., et al., "A Receptor Kinase Gene Regulating Symbiotic Nodule Development," Nature, 2002, pp. 962-966, vol. 417.

Faria, D. C., et al., "Endophytic Bacteria Isolated from Orchid and Their Potential to Promote Plant Growth," World J Microbiol Biotechnol., 2013, pp. 217-221, vol. 29.

Ferrando, L., et al., "Molecular and Culture-Dependent Analyses Revealed Similarities in the Endophytic Bacterial Community Composition of Leaves from Three Rice (*Oryza sativa*) Varieties," FEMS Microbiol Ecol., 2012, pp. 696-708, vol. 80.

Fiehn, O., et al., "Metabolite Profiling for Plant Functional Genomics," Nature Biotechnol., 2000, pp. 1157-1161, vol. 8.

Fierer, N., et al., "Cross-Biome Metagenomic Analyses of Soil Microbial Communities and Their Functional Attributes," Proc Natl Acad Sci USA, 2012, pp. 21390-21395, vol. 109, No. 52.

Fincher, G. B., "Molecular and Cellular Biology Associated with Endosperm Mobilization in Germinating Cereal Grains," Annu Rev Plant Phvsiol Plant Mol Biol., 1989, pp. 305-346, vol. 40.

Fisher, P. J., et al., "Fungal saprobes and pathogens as endophytes of rice (*Oryza sativa* L.)," New Phytol., 1992, pp. 137-143, vol. 120.

Fisher, P. R., et al., "Isolation and Characterization of the Pesticide-Degrading Plasmid pJP1 from Alcaligenes paradoxus," J Bacteriol., 1978, pp. 798-804, vol. 135, No. 3.

Franco, C., et al., "Actinobacterial Endophytes for Improved Crop Performance," Australasian Plant Pathology, 2007, pp. 524-531, vol. 36.

Fulthorpe, R. R., et al., "Distantly Sampled Soils Carry Few Species in Common," ISME J., 2008, pp. 901-910, vol. 2.

Gantner, S., et al., "Novel Primers for 16S rRNA-based Archaeal Community Analyses in Environmental Samples," J Microbiol Methods, 2011, pp. 12-18, vol. 84.

Gao, Z., et al., "Quantitation of Major Human Cutaneous Bacterial and Fungal Populations," J Clin Microbiol., 2010, pp. 3575-3581, vol. 48, No. 10.

Gasser, I., et al., "Ecology and Characterization of Polyhydroxyalkanoate-Producing Microorganisms on and in Plants," FEMS Microbiol Ecol., 2010, pp. 142-150, vol. 70.

Gavrish, E, et al., "*Lentzea* sp. MS6 16S Ribosomal RNA Gene, Partial Sequence," NCBI GenBank Accession No. EF599958. Submitted May 9, 2007.

Gilmour, S. J., et al., "Overexpression of the *Arabidopsis* CBF3 Transcriptional Activator Mimics Multiple Biochemical Changes Associated with Cold Acclimation," Plant Physiol., 2000, pp. 1854-1865, vol. 124.

Giraldo, A., et al., "Phylogeny of Sarocladium (Hypocreales)," Persoonia, 2015, pp. 10-24, vol. 34.

Gitaitis, R., et al., "The Epidemiology and Management of Seedborne Bacterial Diseases," Annu Rev Phytopathol., 2007, pp. 371-397, vol. 45.

Grondona, I., et al., "TUSAL®, a commercial biocontrol formulation based on Trichoderma," Bulletin OILB/SROP, 2004, pp. 285-288, vol. 27, No. 8.

Gu, O., et al., "*Glycomyces sambucus* sp. nov., an endophytic actinomycete islolated from the stem of Sambucus adnata Wall," International Journal of Systematic and Evolutionary Microbiology, 2007, pp. 1995-1998, vol. 57.

Haake, V., et al., "Transcription Factor CBF4 is a Regulator of Drought Adaptation in *Arabidopsis*," Plant Physiol., 2002, pp. 639-648, vol. 130.

Haas, D., et al., "R Factor Variants with Enhanced Sex Factor Activity in Pseudomonas aeruginosa," Mol Gen Genet., 1976, pp. 243-251, vol. 144.

Hallman, J., et al., "Bacterial Endophytes in Agricultural Crops," Canadian J Microbiol., 1997, pp. 895-914, vol. 43.

Hanson, L.E., "Reduction of Verticillium Wilt Symptoms in Cotton Following Seed Treatment with Trichoderma virens," The Journal of Cotton Science, 2000, pp. 224-231, vol. 4, No. 4.

Hanson, L.E., "Reduction of Verticillium Wilt Symptoms in Cotton Following Seed Treatment with Trichoderma virens," Proceedings Beltwide Cotton Conferences, 2000, vol. 1. (Abstract).

Hardegree, S. P. et al., "Effect of Polyethylene Glycol Exclusion on the Water Potential of Solution-Saturated Filter Paper," Plant Physiol., 1990, pp. 462-466, vol. 92.

Hardoim, P. R., et al., "Assessment of Rice Root Endophytes and Their Potential for Plant Growth Promotion," In: Hardoim, P.R., Bacterial Endophytes of Rice—Their Diversity, Characteristics and Perspectives, Groningen, 2011, pp. 77-100.

Hardoim, P. R., et al., "Dynamics of Seed-Borne Rice Endophytes on Early Plant Growth Stages," PLoS ONE, 2012, vol. 7, No. 2, 13 Pages.

Harman, G.E., et al., "Symposium: biocontrol and biotechnological methods for controlling cotton pests," Proceedings of the Beltwide Cotton Production Research Conf., 1989, Memphis, Tennessee, USA, pp. 15-20. (Abstract).

Hepler, P. K., et al., "Polarized Cell Growth in Higher Plants," Annu Rev Cell Dev Biol., 2001, pp. 159-187, vol. 17.

Hiatt, E. E., et al., "Tall Fescue Endophyte Detection: Commerical Immunoblot Test Kit Compared with Microscopic Analysis," Crop Science, 1999, pp. 796-799, vol. 39.

Hibbett, D. S., et al., "A Higher-Level Phylogenetic Classification of the Fungi," Mycol Res., 2007, pp. 509-547, vol. 111.

Hill, N. S., et al., "Endophyte Survival during Seed Storage: Endophyte-Host Interactions and Heritability," Crop Sci., 2009, pp. 1425-1430, vol. 49.

Hill N. S., et al., "Endophyte Survival during Seed Storage: Endophyte-Host Interactions and Heritability," PowerPoint, Dept. Crop Soil Sciences, University of Georgia, Nov. 16, 2012, 3 Pages.

Hinton, D. M., et al., "*Enterobacter cloacae* is an endophytic symbiont of corn," Mycopathologia, 1995, pp. 117-125, vol. 129.

Howell, C.R., et al., "Induction of Terpenoid Synthesis in Cotton Roots and Control of Rhizoctonia solani by Seed Treatment with Trichoderma virens," Phytopathology, 2000, pp. 248-252, vol. 90, No. 3.

Hubbard, M., et al., "Fungal Endophytes Improve Wheat Seed Germination Under Heat and Drought Stress," Botany, 2012, pp. 137-149, vol. 90.

Hung, P.Q., et al., "Isolation and Characterization of Endophytic Bacteria in Soybean (*Glycine* sp.)," Omonrice, 2004, pp. 92-101, vol. 12.

Idris, A., et al., "Efficacy of Rhizobacteria for Growth Promotion in Sorghum Under Greenhouse Conditions and Selected Modes of Action Studies," J Agr Sci., 2009, pp. 17-30, vol. 147.

Ikeda, S., et al., "The Genotype of the Calcium/Calmodulin-Dependent Protein Kinase Gene (CCaMK) Determines Bacterial Community Diversity in Rice Roots Under Paddy and Upland Field Conditions," Applied and Environmental Microbiology, 2011, pp. 4399-4405, vol. 77, No. 13.

Imoto, K., et al., "Comprehensive Approach to Genes Involved in Cell Wall Modifications in *Arabidopsis thaliana*," Plant Mol Biol., 2005, pp. 177-192, vol. 58.

Jalgaonwala, R., et al., "A Review on Microbial Endophytes from Plants: A Treasure Search for Biologically Active Metabolites,"

(56) References Cited

OTHER PUBLICATIONS

Global Journal of Research on Medicinal Plants & Indigenous Medicine, 2014, pp. 263-277, vol. 3, No. 6.
Janda, J. M., et al., "16S rRNA Gene Sequencing for Bacterial Identification in the Diagnostic Laboratory: Pluses, Perils, and Pitfalls," Journal of Clinical Microbiology, 2007, pp. 2761-2764, vol. 45, No. 9.
Johnston-Monje, D., et al., "Conservation and Diversity of Seed Associated Endophytes in Zea Across Boundaries of Evolution, Ethnography and Ecology," PLoS ONE, 2011, vol. 6, No. 6, 22 Pages.
Johnston-Monje, D., et al., "Plant and Endophyte Relationships: Nutrient Management," Comprehensive Biotechnol., 2011, pp. 713-727, vol. 4.
Johnston-Monje, D., "Microbial Ecology of Endophytic Bacteria in Zea Species as Influenced by Plant Genotype, Seed Origin, and Soil Environment," Thesis, University of Guelph, 2011, 230 Pages.
Jones, K.L., "Fresh Isolates of Actinomycetes in which the Presence of Sporogenous Aerial Mycelia is a Fluctuating Characteristic," J Bacteriol., 1949, pp. 141-145, vol. 57, No. 2.
Kaga, H., et al., "Rice Seeds as Sources of Endophytic Bacteria," Microbes Environ., 2009, pp. 154-162,vol. 24, No. 2.
Kalns, L., et al., "The Effects of Cotton Fungal Endophytes in the Field on Arthropod Community Structure," Power Point Presentation dated Jan. 7, 2013.
Kang, B. H., et al., "Members of the Arabidopsis Dynamin-Like Gene Family, ADL1, are Essential for Plant Cytokinesis and Polarized Cell Growth," Plant Cell, 2003, pp. 899-913, vol. 15.
Kasana, R. C., et al., "A Rapid and Easy Method for the Detection of Microbial Cellulases on Agar Plates Using Gram's Iodine," Curr Microbiol., 2008, pp. 503-507, vol. 57.
Khan, A.L., et al., "Salinity Stress Resistance Offered by Endophytic Fungal Interaction Between Penicillium minioluteum LHL09 and Glycine max. L," J. Microbiol. Biotechnol., 2011, pp. 893-902, vol. 21, No. 9.
Kruger, M., et al., "DNA-Based Species Level Detection of Glomeromycota: One PCR Primer Set for All Arbuscular Mycorrhizal Fungi," New Phvtol., 2009, pp. 212-223, vol. 183.
Kuklinsky-Sobral, J., et al., "Isolation and Characterization of Endophytic Bacteria from Soybean (Glycine max) Grown in Soil Treated with Glyphosate Herbicide," Plant and Soil, 2005, pp. 91-99, vol. 273.
Lanver, D., et al., "Sho1 and Msb2-Related Proteins Regulate Appressorium Development in the Smut Fungus Ustilago aydis," Plant Cell, 2010, pp. 2085-2101, vol. 22.
Laus, M. C., et al., "Role of Cellulose Fibrils and Exopolysaccharides of Rhizobium leguminosarum in Attachment to and Infection of Vicia sativa Root Hairs," Mol Plant Microbe Interact., 2005, pp. 533-538, vol. 18, No. 6.
Le, X.H., et al., "Effects of endophytic Streptomyces on the lucerne (Medicago sativa L.) symbiosis at different levels of nitrogen," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 66-67.
Le, X.H., et al., "Isolation and characterisation of endophytic actinobacteria and their effect on the early growth and nodulation of lucerne (Medicago sativa L.)," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 134-136.
Lehman, S.G., "Treat Cotton Seed," Review of Applied Mycology, 1945, 24, 369.
Lehman, S.G., "Treat Cotton Seed," Research and Farming III, Progr. Rept., 1945, 3, 5.
Leonard, C. A., et al., "Random Mutagenesis of the Aspergillus oryzae Genome Results in Fungal Antibacterial Activity," Int J Microbiol., 2013, vol. 2013, Article ID 901697, 6 Pages.
Li, H. M., et al., "Expression of a Novel Chitinase by the Fungal Endophyte in Poa ampla," Mycologia, 2004, pp. 526-536, vol. 96, No. 3.
Li, H., et al., "Endophytes and their role in phytoremediation," Fungal Diversity, 2012, pp. 11-18, vol. 54.
Li, Q., "Agrobacterium tumefaciens Strain TA-AT-10 16S Ribosomal RNA Gene, Partial Sequence: GenBank: KF673157.1," Submitted Sep. 17, 2013.
Liu, M., et al., "A Novel Screening Method for Isolating Exopolysaccharide-Deficient Mutants," Appl Environ Microbiol., 1998, pp. 4600-4602, vol. 64, No. 11.
Liu, Y., et al., "Investigation on Diversity and Population Succession Dynamics of Endophytic Bacteria from Seeds of Maize (Zea mays L., Nongda108) at Different Growth Stages," Ann Microbiol., 2013, pp. 71-79, vol. 63.
Liu, D., et al., "Osmotin Overexpression in Potato Delays Development of Disease Symptoms," Proc Natl Acad Sci USA, 1994, pp. 1888-1892, vol. 91.
Liu, Y., et al., "Study on Diversity of Endophytic Bacterial Communities in Seeds of Hybrid Maize and their Parental Lines," Arch Microbiol., 2012, pp. 1001-1012, vol. 194.
Long, H. H., et al., "The Structure of the Culturable Root Bacterial Endophyte Community of Nicotiana attenuata is Organized by Soil Composition and Host Plant Ethylene Production and Perception," New Phytol., 2010, pp. 554-567, vol. 185.
Lopez-Lopez, A., et al., "Phaseolus vulgaris Seed-Borne Endophytic Community with Novel Bacterial Species such as Rhizobium endophyticum sp. nov.," Systematic Appl Microbiol., 2010, pp. 322-327, vol. 33.
Lorck, H., "Production of Hydrocyanic Acid by Bacteria," Physiol Plant, 1948, pp. 142-146, vol. 1.
Lugtenberg, B., et al., "Plant-Growth-Promoting Rhizobacteria," Ann. Rev. Microbiol., 2009, pp. 541-556, vol. 63.
Lundberg, D. S., et al., "Defining the Core Arabidopsis thaliana Root Microbiome," Nature, 2012, pp. 86-90, vol. 488, No. 7409.
Lundberg, D. S., et al., "Practical Innovations for High-Throughput Amplicon Sequencing," Nat Methods, 2013, pp. 999-1002, vol. 10, No. 10.
Ma, Y., et al., "Plant Growth Promoting Rhizobacteria and Endophytes Accelerate Phytoremediation of Metalliferous Soils," Biotechnology Advances, 2011, pp. 248-258, vol. 29.
Madi, L. et al., "Aggregation in Azospirillum brasilense Cd: Conditions and Factors Involved in Cell-to-Cell Adhesion," Plant Soil, 1989, pp. 89-98, vol. 115.
Mannisto, M.K., et al., "Characterization of Psychrotolerant Heterotrophic Bacteria From Finnish Lapland," SVST Appl Microbiol., 2006, pp. 229-243, vol. 29.
Mano, H., et al., "Culturable Surface and Endophytic Bacterial Flora of the Maturing Seeds of Rice Plants (Oryza sativa) Cultivated in a Paddy Field," Microbes Environ., 2006, vol. 21, No. 2.
Manter, D. K., et al., "Use of the ITS Primers, ITSIF and ITS4, to Characterize Fungal Abundance and Diversity in Mixed-Template Samples by qPCR and Length Heterogeneity Analysis," J Microbiol Methods, 2007, pp. 7-14, vol. 71.
Mao, W., et al., "Seed Treatment with a Fungal or a Bacterial Antagonist for Reducing Corn Damping-off Caused by Species of Pythium and Fusarium," Plant Disease, 1997, pp. 450-454, vol. 81, No. 5.
Marasco, R., et al., "A Drought Resistance-Promoting Microbiome is Selected by Root System Under Desert Farming," PLoS ONE, 2012, vol. 7, No. 10, 14 Pages.
Marquez, L. M., et al., "A Virus in a Fungus in a Plant: Three-Way Symbiosis Required for Thermal Tolerance," Science, 2007, pp. 513-515, vol. 315.
Mastretta, C., et al., "Endophytic Bacteria from Seeds of Nicotiana Tabacum Can Reduce Cadmium Phytotoxicity," Intl J Phytoremediation, 2009, pp. 251-267, vol. 11.
Mateos, P. F., et al., "Cell-Associated Pectinolytic and Cellulolytic Enzymes in Rhizobium leguminosarum biovar trifolii," Appl Environ Microbiol., 1992, pp. 816-1822, vol. 58, No. 6.
McDonald, D., et al., "An Improved Greengenes Taxonomy with Explicit Ranks for Ecological and Evolutionary Analyses of Bacteria and Archaea," ISME J., 2012, pp. 610-618, vol. 6.
McGuire, K.L., et al., "Digging the New York City Skyline: Soil Fungal Communities in Green Roofs and City Parks," PloS One, 2013, vol. 8, No. 3, 13 Pages.

(56) References Cited

OTHER PUBLICATIONS

Medina, P., et al., "Rapid Identification of Gelatin and Casein Hydrolysis Using TCA," J Microbiol Methods, 2007, pp. 391-393, vol. 69.
Mehnaz, S., et al., "Growth Promoting Effects of Corn (*Zea mays*) Bacterial Isolates Under Greenhouse and Field Conditions," Soil Biology and Biochemistry, 2010, pp. 1848-1856, vol. 42.
Mehnaz, S., et al., "Isolation and 16S rRNA sequence analysis of the beneficial bacteria from the rhizosphere of rice," Canada Journal of Microbiology, 2001, pp. 110-117, vol. 47, No. 2.
Mei, C., et al., "The Use of Beneficial Microbial Endophytes for Plant Biomass and Stress Tolerance Improvement," Recent Patents on Biotechnology, 2010, pp. 81-95, vol. 4.
Michel, B. E., et al., "The Osmotic Potential of Polyethylene Glycol 6000," Plant Physiol., 1973, pp. 914-916, vol. 51.
Moe, L. A., "Amino Acids in the Rhizosphere: From Plants to Microbes," American Journal of Botany, 2013, pp. 1692-1705, vol. 100, No. 9.
Mohiddin, F. A., et al., "Tolerance of Fungal and Bacterial Biocontrol Agents to Six Pesticides Commonly Used in the Control of Soil Borne Plant Pathogens," African Journal of Agricultural Research, 2013, pp. 5331-5334, vol. 8, No. 43.
Mousa, W. K., et al., "The Diversity of Anti-Microbial Secondary Metabolites Produced by Fungal Endophytes: An Interdisciplinary Perspective," Front Microbiol., 2013, vol. 4, No. 65, 18 Pages.
Mundt, J.O., et al., "Bacteria Within Ovules and Seeds," Appl Environ Microbiol., 1976, pp. 694-698, vol. 32, No. 5.
Naik, B. S., et al., "Study on the diversity of endophytic communities from rice (*Oryza sativa* L.) and their antagonistic activities in vitro," Microbiological Research, 2009, pp. 290-296, vol. 164.
Naveed, M., "Maize Endophytes—Diversity, Functionality and Application Potential," University of Natural Resources and Life Sciences, 2013, pp. 1-266 and 81-87; Tables 1-3; Figure 2.
Nejad, P. et al., "Endophytic Bacteria Induce Growth Promotion and Wilt Disease Suppression in Oilseed Rape and Tomato," Biological Control, 2000, pp. 208-215, vol. 18.
Neslon, E.B., "Microbial Dynamics and Interactions in the Spermosphere," Ann. Rev. Phytopathol., 2004, pp. 271-309, vol. 42.
Nikolcheva, L.G., et al., "Taxon-Specific Fungal Primers Reveal Unexpectedly High Diversity During Leaf Decomposition in a Stream," Mycological Progress, 2004, pp. 41-49, vol. 3, No. 1.
Nimnoi, P., et al., "Co-Inoculation of Soybean (*Glycin max*) with Actinomycetes and Bradyrhizobium Japonicum Enhances Plant Growth, Nitrogenase Activity and Plant Nutrition," Journal of Plant Nutrition, 2014, pp. 432-446, vol. 37.
Normander, B., et al., "Bacterial Origin and Community Composition in the Barley Phytosphere as a Function of Habitat and Presowing Conditions," Appl Environ Microbiol., Oct. 2000, pp. 4372-4377, vol. 66, No. 10.
Okunishi, S., et al., "Bacterial Flora of Endophytes in the Maturing Seeds of Cultivated Rice (*Oryza sativa*)," Microbes and Environment, 2005, pp. 168-177, vol. 20, No. 3.
Orole, O. O., et al., "Bacterial and fungal endophytes associated with grains and roots of maize," Journal of Ecology and the Natural Enviornment, 2011, pp. 298-303, vol. 3, No. 9.
Partida-Martinez, L.P., et al., "The Microbe-Free Plant: Fact or Artifact?" Front Plant Sci., 2011, vol. 2, No. 100, 16 Pages.
Pearson, W.R., et al., "Rapid and Sensitive Sequence Comparison With FASTP and FASTA," Methods Enzymol., 2011, pp. 63-98, vol. 183.
Pedraza, R. O., et al., "Azospirillum inoculation and nitrogen fertilization effect on grain yield and on the diversity of endophytic bacteria in the phyllosphere of rice rainfed crop," European Journal of Soil Biology, 2009, pp. 36-43, vol. 45.
Perez-Fernandez, M. A., et al., "Simulation of Germination of Pioneer Species Along an Experimental Drought Gradient," J Environ Biol., 2006, pp. 669-685, vol. 27, No. 4.
Perez-Miranda, S., et al., "O-CAS, A Fast and Universal Method for Siderophore Detection," J Microbiol Methods, 2007, pp. 127-131, vol. 70.
Petti, C. A., "Detection and Identification of Microorganisms by Gene Amplification and Sequencing," Clinical Infectious Diseases, 2007, pp. 1108-1114, vol. 44.
Phalip, V., et al., "A Method for Screening Diacetyl and Acetoin-Producing Bacteria on Agar Plates," J Basic Microbiol.,1994, pp. 277-280, vol. 34.
Philippot, L., et al., "Going Back to the Roots: The Microbial Ecology of the Rhizosphere," Nat Rev Microbiol., Nov. 2013, pp. 789-799, vol. 11.
Philrice Batac, Philippine Rice R&D Highlights, 2012, Area-Based R&D Projects, [online][Retrieved Aug. 11, 2016] Retrieved from the Internet <URL:http://www.philrice.gov.ph/2012-rd-highlights/>.
Pillay, V. K., et al., "Inoculum Density, Temperature, and Genotype Effects on in vitro Growth Promotion and Epiphytic and Endophytic Colonization of Tomato (*Lycopersicon esculentum* L.) Seedlings Inoculated with a Pseudomonad Bacterium," Can J Microbiol.,1997, pp. 354-361, vol. 43.
Powell, W. A., et al., "Evidence of Endophytic Beauveria Bassiana in Seed-Treated Tomato Plants Acting as a Systemic Entomopathogen to Larval Helicoverpa zea (Lepidoptera: Noctuidae)," J. Entomol. Sci., 2009, pp. 391-396, vol. 44, No. 4.
Quadt-Hallmann, A., et al., "Bacterial Endophytes in Cotton: Mechanisms of Entering the Plant," Can J Microbiol., 1997, pp. 577-582, vol. 43.
R Core Team, "R: A Language and Environment for Statistical Computing," R Foundation for Statistical Computing, Vienna, Austria, May 2013, ISBN: 3-900051-07-0. Available online at http://www.R- 25project.org/, 3604 Pages.
Rasmussen, S., et al., "Grass-endophyte interactions: a note on the role of monosaccharide transport in the Neotyphodium lolii-Lolium perenne symbiosis," New Phytologist, 2012, pp. 7-12, vol. 196.
Ravel, C., et al., "Beneficial effects of Neotyphodium lolii on the growth and the water status in perennial ryegrass cultivated under nitrogen deficiency or drought stress," Agronomie, 1997, pp. 173-181, vol. 17.
Redman, R. S., et al., "Thermotolerance Generated by Plant/Fungal Symbiosis," Science, Nov. 2002, vol. 298, 1 Page (with 4 pages of supplemental material).
Reiter, B., et al., "Response of Endophytic Bacterial Communities in Potato Plants to Infection with *Erwinia carotovora* subsp. *atroseptica*," Appl Environ Microbiol., 2001, pp. 2261-2268, vol. 68, No. 5.
Rodriguez, H., et al., "Expression of a Mineral Phosphate Solubilizing Gene From Erwinia herbicola in Two Rhizobacterial Strains," J Biotechnol., 2001, pp. 155-161, vol. 84.
Rodriguez, R.J., et al., "Stress Tolerance in Plants via Habitat-Adapted Symbiosis," ISME J., 2008, pp. 404-416, vol. 2.
Rodriguez-Navarro, D., et al., "Soybean Interactions with Soil Microbes, Agronomical and Molecular Aspects," Agronomy for Sustainable Development, 2011, pp. 173-190, vol. 31, No. 1.
Roessner, U., et al., "Metabolic Profiling Allows Comprehensive Phenotyping of Genetically or Environmentally Modified Plant Systems," Plant Cell, 2001, pp. 11-29, vol. 13.
Rosado, A. S., et al., "Phenotypic and Genetic Diversity of Paenibacillus azotofixans Strains Isolated from the Rhizoplane or Rhizosphere Soil of Different Grasses," J App Microbiol., 1998, pp. 216-226, vol. 84.
Rosenblueth, A., et al., "Seed Bacterial Endophytes: Common Genera, Seed-to-Seed Variability and Their Possible Role in Plants," Acta Hort., 2012, pp. 39-48, vol. 938.
Rosenblueth, M., et al., "Bacterial Endophytes and Their Interactions With Host," Molecular Plant-Microbe Interactions, 2006, pp. 827-837, vol. 19, No. 8.
Ross, P.L., et al., "Multiplexed Protein Quantitation in *Saccharomyces cerevisiae* Using Amine-Reactive Isobaric Tagging Reagents," Mol Cell Proteomics, 2004, pp. 1154-1169, vol. 3, No. 12.
Saleem, M., et al., "Perspective of Plant Growth Promoting Rhizobacteria (PGPR) Containing ACC Deaminase in Stress Agriculture," J Ind Microbiol Biotechnol., Oct. 2007, pp. 635-648, vol. 34.

(56) References Cited

OTHER PUBLICATIONS

Samac, D.A., et al., "Recent Advances in Legume-Microbe Interactions: Recognition, Defense Response, and Symbiosis from a Genomic Perspective," Plant Physiol., 2007, pp. 582-587, vol. 144.

Sardi, P., et al., "Isolation of Endophytic Streptomyces Strains from Surface Sterilized Roots," Applied and Environmental Microbiology, 1992, pp. 2691-2693, vol. 58, No. 8.

Sarwar, M., et al., "Tryptophan Dependent Biosynthesis of Auxins in Soil," Plant Soil, 1992, pp. 207-215, vol. 147.

Schmieder, R., et al., "Quality Control and Preprocessing of Metagenomic Datasets," Bioinformatics, 2011, pp. 863-864, vol. 27, No. 6.

Schoch, C. L., et al., "Nuclear Ribosomal Internal Transcribed Spacer (ITS) Region as a Universal DNA Barcode Marker for Fungi," Proc Natl Acad Sci USA, 2012, pp. 6241-6246, vol. 109, No. 16.

Schwyn, B. et al., "Universal Chemical Assay for the Detection and Determination of Siderophores," Analytical Biochemistry, 1987, pp. 47-56, vol. 160.

Sessitsch, A., et al., "*Burkholderia phytofirmans* sp. Nov., a novel plant-associated bacterium with plant-beneficial properties," International Journal of Systematic and Evoluntary Microbiology, 2005, pp. 1187-1192, vol. 55.

Shapiro-Ilan, D.I., et al., "The Potential for Enhanced Fungicide Resistance in Beauveria Bassiana Through Strain Discovery and Artificial Selection," Journal of Invertebrate Pathology, 2002, pp. 86-93, vol. 81.

Shankar, M., et al.,"Root colonization of a rice growth promoting strain of Enterobacter cloacae," Journal of Basic Microbiology, 2011, pp. 523-530, vol. 51.

Singh, A. K., et al., "Uncultured *Actinomyces* sp. Clone EMLACT 80 IV (New) 16S Ribosomal RNA Gene, Partial Sequence," NCBI GenBank Accession No. JQ285908. Submitted Dec. 13, 2011.

Soares, M. M. C. N., et al., "Screening of Bacterial Strains for Pectinolytic Activity: Characterization of the Polygalacturonase Produced by *Bacillus* SP," Revista de Microbiolgia, 1999, pp. 299-303, vol. 30.

Soe, K.M., et al., "Effects of endophytic actinomycetes and Bradyrhizobium japonicum strains on growth, nodulation, nitrogen fixation and seed weight of different soybean varieties," Soil Science and Plant Nutrition, 2012, pp. 319-325, vol. 58, No. 3.

Soe, K.M., et al., "Low-Density Co-Inoculation of Myanmar Bradyrhizobium yuanmingense MAS34 and Streptomyces griseoflavus P4 to Enhance Symbiosis and Seed Yield in Soybean Varieties," American Journal of Plant Sciences, 2013, pp. 1879-1892, vol. 4.

Song, M., et al., "Effects of Neotyphodium Endophyte on Germination of Hordeum brevisubulatum under Temperature and Water Stress Conditions," Acta Agrestia Sinica, 2010, pp. 834-837, vol. 18, No. 6. (English Abstract).

Souleimanov, A., et al., "The Major Nod Factor of Bradyrhizobium japonicum Promotes Early Growth of Soybean and Corn," J. Exp. Bot., 2002, pp. 1929-1934, vol. 53, No. 376.

Spiekermann, P., et al., "A Sensitive, Viable-Colony Staining Method Using Nile Red for Direct Screening of Bacteria that Accumulate Polyhydroxyalkanoic Acids and Other Lipid Storage Compounds," Arch Microbiol., 1999, pp. 73-80, vol. 171.

Staudt, A. K., et al., "Variations in Exopolysaccharide Production by Rhizobium tropici," Arch Microbiol., 2012, pp. 197-206, vol. 194.

Strobel, G. A., "Endophytes as Sources of Bioactive Products," Microbes and Infection, 2003, pp. 535-544, vol. 5.

Sturz, A. V., et al., "Weeds as a Source of Plant Growth Promoting Rhizobacteria in Agricultural Soils," Can J Microbiol., 2001, pp. 1013-1024, vol. 47, No. 11.

Surette, M. A., et al. "Bacterial Endophytes in Processing Carrots (*Daucus carota* L. var. *sativus*): Their Localization, Population Density, Biodiversity and Their Effects on Plant Growth," Plant and Soil, 2003, pp. 381-390, vol. 253, No. 2.

Suto, M., et al., "Endophytes as Producers of Xylanase," J Biosci Bioeng., 2002, pp. 88-90, vol. 93, No. 1.

Sword, G., "Manipulating Fungal Endophytes to Protect Plants from Insects and Nematodes," Power Point Presentation dated Aug. 7, 2013.

Sword, G., et al., "Manipulating Fungal Endophytes for the Protection of Cotton in the Field," Power Point Presentation dated Jan. 7, 2013.

Sword, G., et al., "Field Trials of Potentially Beneficial Fungal Endophytes in Cotton," Power Point Presentation dated Jan. 7, 2013.

Sword, G., "Fungal Endophytes to Protect Cotton from Insects and Nematodes," Power Point Presentation dated Dec. 7, 2012.

Sword, G., "Natural Enemies—The Forgotten Basis of IPM?" Power Point Presentation dated Sep. 6, 2013.

Taghavi, S., et al., "Genome Survey and Characterization of Endophytic Bacteria Exhibiting a Beneficial Effect on Growth and Development of Poplar Trees," Applied and Environmental Microbiology, 2009, pp. 748-757, vol. 75, No. 3.

Taylor, A. G., et al., "Concepts and Technologies of Selected Seed Treatments," Annu. Rev. Phytopathol., 1990, pp. 321-339, vol. 28.

Teather, R. M., et al., "Use of Congo Red-Polysaccharide Interactions in Enumeration and Characterization of Cellulolytic Bacteria from the Bovine Rumen," Appl Environ Microbiol., 1982, pp. 777-780, vol. 43, No. 4.

Theis, K. R., et al., "Uncultured Bacterium Clone GM2GI8201A64RC 16S Ribosomal RNA Gene, Partial Sequence," NCBI GenBank Accession No. JX051943, Submitted May 14, 2012.

Thomas, L., et al., "Development of Resistance to Chlorhexidine Diacetate in Pseudomonas aeruginosa and the Effect of a "Residual" Concentration," J Hosp Infect., 2000, pp. 297-303, vol. 46.

Thomashow, M. F., "So What's New in the Field of Plant Cold Acclimation? Lots!," Plant Physiol., 2001, pp. 89-93, vol. 125.

Tokala, R. T., et al., "Novel Plant-Microbe Rhizosphere Interaction Involving Streptomyces Lydicus WYEC108 and the Pea Plant (*Pisum sativum*)," Applied and Environmental Microbiology, May 2002, pp. 2161-2171, vol. 68, No. 5.

Trichoderma definition, 2016, [online] [Retrieved on Sep. 16, 2016,] Retrieved from the Internet <URL:https://en.wikipedia.org/wiki/Trichoderma>.

Trotel-Aziz, P., et al., "Characterization of New Bacterial Biocontrol Agents Acinetobacter, Bacillus, Pantoea and Pseudomonas spp. Mediating Grapevine Resistance Against Botrytis cinerea," Environmental and Experimental Botany, 2008, pp. 21-32, vol. 64.

Truyens, S., et al., "Changes in the Population of Seed Bacteria of Transgenerationally Cd-Exposed *Arabidopsis thaliana*," Plant Biol., 2013, pp. 971-981, vol. 15.

Usadel, B., et al., "The Plant Transcriptome—From Integrating Observations to Models," Front Plant Sci., 2013, pp. 1-3, vol. 4., Article 48, 3 Pages.

Vacheron, J., et al., "Plant Growth-Promoting Rhizobacteria and Root System Functioning," Frontiers Plant Sci., 2013, vol. 4, Article 356, 19 Pages.

Valencia, C. U., et al., "Endophytic Establishment as an Unintended Consequence of Biocontrol with Fungal Entomopathogens," Power Point Presentation dated Jan. 7, 2013.

Van Der Lelie, D., et al., "Poplar and its Bacterial Endophytes: Coexistence and Harmony," Critical Rev Plant Sci., 2009, pp. 346-358, vol. 28.

Vining, K., et al., "Methylome Reorganization During in vitro Dedifferentiation and Regeneration of Populus trichocarpa," BMC Plant Biol., 2013, vol. 13, No. 92, 15 Pages.

Viruel, E., et al., "Pseudomonas thiveralensis Strain IEHa 16S Ribosomal RNA Fene, Partial Sequence," NCBI GenBank Accession No. GQ169380.1, Submitted May 15, 2009.

Waller, F., et al., "The Endophytic Fungus *Piriformospora indica* Reprograms Barley to Salt-Stress Tolerance, Disease Resistance, and Higher Yield," PNAS, 2005, pp. 13386-13391, vol. 102, No. 38.

Wang, B., et al., "Fungal endophytes of native *Gossypium* species in Australia," Mycological Research, 2007, pp. 347-354, vol. 111, No. 3.

Wang, K., et al., "Monitoring in Planta Bacterial Infection at Both Cellular and Whole-Plant Levels Using the Green Fluorescent Protein Variant GFPuv," New Phytol., 2007, pp. 212-223, vol. 174.

(56) References Cited

OTHER PUBLICATIONS

Wang, Q., et al., "Naive Bayesian Classifier for Rapid Assignment of rRNA Sequences into the New Bacterial Taxonomy," Appl. Environ. Microbiol., 2007, pp. 5261-5267, vol. 73, No. 16.

Waqas, M., et al., "Endophytic Fungi Produce Gibberellins and Indoleacetic Acid and Promotes Host-Plant Growth during Stress," Molecules, 2012, pp. 10754-10773, vol. 17.

Weaver, P.F., et al., "Characterization of Rhodopseudomonas capsulata," Arch Microbiol., 1975, pp. 207-216, vol. 105.

Weindling, R., "Relation of dosage to control of cotton seedling diseases by seed treatment," Plant Disease Reporter, 1943, 27, 68-70.

Welty, R.E., et al., "Influence of Moisture Content, Temperature, and Length of Storage on Seed Germination and Survival of Endophytic Fungi in Seeds of Tall Fescue and Perennial Ryegrass," Phytopathyol., 1987, pp. 893-900, vol. 77, No. 6.

White, J. F., et al., "A Proposed Mechanism for Nitrogen Acquisition by Grass Seedlings Through Oxidation of Symbiotic Bacteria," Symbiosis, 2012, pp. 161-171, vol. 57.

Wiegand, I., et al., "Agar and Broth Dilution Methods to Determine the Minimal Inhibitory Concentration (MIC) of Antimicrobial Substances," Nature Protocols, 2008, pp. 163-175, vol. 3, No. 2.

Xu, M., et al., "Bacterial Community Compositions of Tomato (*Lycopersicum esculentum* Mill.) Seeds and Plant Growth Promoting Activity of ACC Deaminase Producing Bacillus subtilis (HYT-12-1) on Tomato Seedlings," World J Microbiol Biotechnol., 2014, pp. 835-845, vol. 30.

Xu, Y., et al., "Biosynthesis of the Cyclooligomer Despipeptide bassianolide, an Insecticidal Virulence Factor of Beauveria bassiana," Fungal Genetics and Biology, 2009, pp. 353-364, vol. 46.

Xue, Q.Y., et al., "Evaluation of the Strains of Acinetobacter and Enterobacter as potential Biocontrol Agents Against Ralstonia Wilt of Tomato," Biological Control, 2009, vol. 48, pp. 252-258.

Yandigeri, M. S., et al., "Drought-tolerant endophytic actinobacteria promote growth of wheat (*Triticum aestivum*) under water stress conditions," Plant Growth Regulation, 2012, pp. 411-420, vol. 68.

Yezerski, A., et al., "The Effects of the Presence of Stored Product Pests on the Microfauna of a Flour Community," Journal of Applied Microbiology, 2005, pp. 507-515, vol. 98.

You, Y., et al., "Analysis of Genomic Diversity of Endophytic Fungal Strains Isolated from the Roots of Suaeda japonica and S. maritima for the Restoration of Ecosystems in Buan Salt Marsh," Korean Journal of Microbiology and Biotechnology, 2012, pp. 287-295, vol. 40, No. 4. (with English Abstract).

Zhou, W., et al., "Effects of the Fungal Endophyte *Paecilomyces* sp. in Cotton on the Roo-Knot Nematode *Meloidogyne incognita*," poster dated Jan. 7, 2013.

Zimmerman, N.B., et al., "Fungal Endophyte Communities Reflect Environmental Structuring Across a Hawaiian Landscape," Proc Natl Acad Sci USA, 2012, pp. 13022-13027, vol. 109, No. 32.

Zuccaro, A., et al., "Endophytic Life Strategies Decoded by Genome and Transcriptome Analyses of the Mutualistic Root Symbiont *Piriformospora indica*," PLOS Pathogens, 2011, vol. 7, No. 10, e1002290.

Zuniga, A., et al., "Quorum Sensing and Indole-3-Acetic Acid Degradation Play a Role in Colonization and Plant Growth Promotion of *Arabidopsis thaliana* by Burkholderia phytofirmans PsJN," Mol Plant Microbe Interact., 2013, pp. 546-553, vol. 26, No. 5.

Canadian Patent Office, Office Action, Canadian Patent Application No. CA 2,953,466, dated Dec. 11, 2017, 7 Pages.

Canadian Patent Office, Office Action, Canadian Patent Application No. CA 2,953,697, dated Oct. 12, 2017, 6 Pages.

Canadian Patent Office, Office Action, Canadian Patent Application No. CA 2,952,057, dated Oct. 12, 2017, 4 Pages.

Canadian Patent Office, Office Action, Canadian Patent Application No. CA 2,929,487, dated Dec. 7, 2017, 4 Pages.

Chinese Patent Office, 2nd Office Action for Chinese Patent Application No. CN 201480072142.7, dated Oct. 30, 2017, 13 Pages, (with English translation).

European Patent Office, Communication Pursuant to Article 94(3) EPC for European Patent Application No. 13874703.5, dated Jan. 5, 2018, 4 Pages.

European Patent Office, Examination Report for European Patent Application No. EP 14777213.1, dated Oct. 20, 2017, 12 Pages.

European Patent Office, Supplementary European Search Report, European Patent Application No. EP 15809264.3, dated Dec. 4, 2017, 16 Pages.

European Patent Office, Communication Pursuant to Article 94(3) EPC for European Patent Application No. 15810847.2, dated Nov. 17, 2017, 17 Pages.

European Patent Office, Supplementary European Search Report, European Patent Application No. EP 15812324.0, dated Nov. 2, 2017, 19 Pages.

Intellectual Property Australia, Examination Report No. 1 for Australian Patent Application No. AU 2017254880, dated Nov. 15, 2017, 2 Pages.

New Zealand Intellectual Property Office, First Examination Report, New Zealand Patent Application No. 726116, dated Sep. 26, 2017, 5 Pages.

New Zealand Intellectual Property Office, First Examination Report for New Zealand Patent Application No. NZ 728483, dated Dec. 8, 2017, 2 Pages.

Russian Patent Office, Office Action for Russian Patent Application No. RU 2017127214, dated Nov. 22, 2017, 4 Pages, (with English translation).

Abdou, R., et al., "Botryorhodines A-D, antifungal and cytotoxic depsidones from *Botryosphaeria rhodina*, an endophyte of the medicinal plant *Bidens pilosa*," Phytochemistry, 2010, vol. 71, pp. 110-116.

Adhikari, M., et al., "A New Record of Pseudeurotium bakeri from Crop Field Soil in Korea," The Korean Journal of Mycology, 2016, pp. 145-149, vol. 44.

Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.

Bensch, K., et al., "Species and ecological diversity within the Cladosporium cladosporioides complex (Davidiellaceae, Capnodiales)," Studies in Mycology, 2010, pp., 1-94, vol. 67.

Chagas, F., et al., "A Mixed Culture of Endophytic Fungi Increases Production of Antifungal Polyketides," J. Chem Ecol., Oct. 2013, pp. 1335-1342, vol. 39.

Clarridge, J., "Impact of 16S rRNA Gene Sequence Analysis for Identification of Bacteria on Clinical Microbiology and Infectious Diseases," Clinical Microbiology Reviews, Oct. 2004, pp. 840-862, vol. 17, No. 4.

DBGET, "Orthology: K14454," 2005, 2 pages, can be retrieved at <URL:http://www.genome.jp/dbget-bin/www_bget?ko:K14454>.

Gebhardt, J., et al., "Characterization of a single soybean cDNA encoding cytosolic and glyoxysomal isozymes of aspartate aminostransferase," Plant Molecular Biology, 1998, pp. 99-108, vol. 37.

GenBank: AF034210.1 "Glycine max aspartate aminotransferase glyoxysomal isozyme AAT1 precursor and aspartate aminotransferase cytosolic isozyme AAT2 (AAT) mRNA, complete cds," NCBI, May 26, 1998, 2 Pages, can be retrieved at <URL:https://www.ncbi.nlm.nih.gov/nuccore/AF034210>.

GenBank: JN210900.1, "*Enterobacter* sp. WS05 16S ribosomal RNA gene, partial sequence," NCBI, Sep. 24, 2012, 1 Page, can be retrieved at <URL:https://www.ncbi.nlm.nih.gov/nuccore/jn210900>.

GenBank: NP_001237541.1, "aspartate aminotransferase glyoxysomal isozyme AAT1 precursor Glycine max," NCBI, Oct. 29, 2016, 2 Pages, can be retrieved at <URL:https://www.ncbi.nlm.nih.gov/protein/NP_001237541.1>.

GenEmbl Database, GenEmbl Record No. KF673660, Sandberg, et al., "Fungal endophytes of aquatic macrophytes: diverse host-generalists characterized by tissue preferences and geographic structure," 2013, 35 Pages.

GenEmbl Database, GenEmbl Record No. KP991588, Huang, et al., "Pervasive effects of wildfire on foliar endophyte communities in montane forest trees," Mar. 2015, 35 Pages.

(56) References Cited

OTHER PUBLICATIONS

GenEmbl Database, GenEmbl Record No. JN872548, 38 Pages, Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
GenEmbl database, GenEmbl Record No. EU 977189, Jan. 21, 2009, 4 pages, Smith, S.A., et al., "Bioactive endophytes warrant intensified exploration and conservation," PloS ONE 3(8):E3052, 2008.
GenEmbl database, GenEmbl Record No. KF011597, Paenibacillus strain No. HA 13, Aug. 26, 2013, 5 Pages, Park, H.J., et al., "Isolation and characterization of humic substances-degrading bacteria from the subarctic Alaska grasslands," J Basic Microbiol, 2013.
Hahm, M-S., et al., "Biological Control and Plant Growth Promoting Capacity of Rhizobacteria and Pepper Under Greenhouse and Field Conditions," The Journal of Microbiology, The Microbiological Society of Korea, Heidelberg, Jun. 30, 2012, pp. 380-385, vol. 50, No. 3.
Kuklinsky-Sobral, J., et al., "Isolation and characterization of soybean-associated bacteria and their potential for plant growth promotion," Environmental Microbiology, 2004, pp. 1244-1251, vol. 6, No. 12.
Labeda, D.P., et al., "Phylogenetic study of the species within the family Streptomycetaceae," Antonie van Leeuwenhoek, 2012, vol. 101, pp. 73-104, Springer.
Misk, A., et al., "Biocontrol of chickpea root rot using endophytic actinobacteria", Biocontrol, vol. 56, No. 5, Mar. 12, 2011, pp. 811-822, XP036215297.
Op De Beeck, M., et al., "Comparison and Validation of Some ITS Primer Pairs Useful for Fungal Metabarcoding Studies," PLOS ONE, Jun. 2014, vol. 9, Issue 6, e97629, pp. 1-11.
Riken, GI No. GMFL01-01-003, 2 Pages, [online] [Retrieved on Dec. 18, 2017] Retrieved from the internet <URL:http://spectra.psc.riken.jp/menta.cgi/rsoy/datail?id=GMFL01-01-D03>.
Senthilkumar, M., et al., "Biocontrol Potential of Soybean Bacterial Endophytes Against Charcoal Rot Fungus, *Rhizoctonia bataticola*," Current Microbiology, 2009, vol. 58, pp. 288-293.
Sogonov, M.V., et al., "The hyphomycete *Teberdinia hygrophila* gen. nov., sp. nov. and related anamorphs of *Pseudeurotium* species," Mycologia, May 2005, pp. 695-709, vol. 97, No. 3.
Thakur, A., et al., "Detrimental effects of endophytic fungus *Nigrospora* sp. on survival and development of Spodoptera litura," Biocontrol Science and Technology, Feb. 1, 2012, pp. 151-161, vol. 22, No. 2.
Thakur, A., et al., "Enhanced Resistance to Spodoptera litura in Endophyte Infected Cauliflower Plants," Environmental Entomology, Apr. 1, 2013, pp. 240-246, vol. 42, No. 2.
Thakur, A., et al., "Suppression of Cellular Immune Response in Spodoptera litura (Lepidoptera: Noctuidae) Larvae by Endophytic Fungi *Nigrospora oryzae* and *Cladosporium uredinicola*,", Annals of the Entomological Society of America, May 1, 2014, pp. 674-679, vol. 107, No. 3.
Verkley, G., et al., "*Paraconiothyrium*, a new genus to accommodate the mycoparasite *Coniothyrium minitans*, anamorphs of Paraphaeosphaeria, and four new species," Studies in Mycology, 2004, pp. 323-335, vol. 50.
Visagie, C.M., et al., "Identification and nomenclature of the genus *Penicillium*," Studies in Mycology, Jun. 2014, pp. 343-371, vol. 78.
Zhang, J., et al: "Isolation and Characterization of Plant Growth-Promoting Rhizobacteria from Wheat Roots by Wheat Germ Agglutinin Labeled with Fluorescein Isothiocyanate", The Journal of Microbiology, Apr. 27, 2012, vol. 50, No. 2, pp. 191-198, GenBank Accession No: JN210900.
Zhao, J.H., et al., "Bioactive secondary metabolites from *Nigrospora* sp. LLGLM003, an endophytic fungus of the medicinal plant *Moringa oleifera lam*." World Journal of Microbiology and Biotechnology, Kluwer Academic Publishers, Feb. 12, 2012, pp. 2107-2112, vol. 28, No. 5.
Garazzino, S., et al., "Osteomyelitis Caused by Enterobacter cancerogenus Infection following a Traumatic Injury: Case Report and Review of the Literature," J Clin Microbiol., Mar. 2005, vol. 43, No. 3, pp. 1459-1461.
Hoffman, M., et al., "Diverse Bacteria Inhabit Living Hyphae of Phylogenetically Diverse Fungal Endophytes," Applied and Environmental Microbiology, Jun. 2010, p. 4063-4075, vol. 76, No. 12.
Hoffman, M., et al., "Endohyphal Bacterium Enhances Production of Indole-3-Acetic Acid by a Foliar Fungal Endophyte," PLOS One, Sep. 24, 2013, pp. 1-8, vol. 8, Issue 9, e73132.
Humann, J., et al., "Complete genome of the onion pathogen *Enterobacter cloacae* EcWSU1," Standard in Genomic Sciences, Dec. 31, 2011, vol. 5, No. 3, pp. 279-286.
Jung, C., et al., "The Effects of Endohyphal Bacteria on Anti-Cancer and Anti-Malaria Metabolites of Endophytic Fungi," Honors Thesis, University of Arizona, May 2012, 15 Pages.
Kim, M., et al., "Towards a taxonomic coherence between average nucleotide identity and 16S rRNA gene sequence similarity for species demarcation of prokaryotes", Int J Systematic Evolutionary Microbial., 2014, vol. 64, pp. 346-351.
Kumar, S., et al., "MEGA7: Molecular Evolutionary Genetics Analysis version 7.0 for bigger datasets," Molecular Biology and Evolution, Mar. 22, 2016, vol. 33, pp. 1870-1874.
Nishijima, K.A., et al., "Demonstrating Pathogenicity of Enterobacter cloacae on Macadamia and Identifying Associated Volatiles of Gray Kernel of Macadamia in Hawaii," Plant Disease, Oct. 2007, vol. 91, No. 10, pp. 1221-1228.
Ren, Y., et al., "Complete Genome Sequence of *Enterobacter cloacae* subsp. *cloacae* Type Strain ATCC 13047," J. Bacteriol. May 2010, vol. 192, No. 9, pp. 2463-2464.
Tamura, K., et al., "Estimation of the number of nucleotide substitutions in the control region of mitochondrial DNA in humans and chimpanzees," Molecular Biology and Evolution, 1993, vol. 10, No. 3, pp. 512-526.
Yennamalli, R., et al., "Endoglucanases: insights into thermostability for biofuel applications", Biotech Biofuels, 2013, vol. 6, Issue 136, pp. 1-9.
PCT Invitation to Pay Additional Fees, PCT Application No. PCT/US2017/064351, dated Feb. 9, 2018, 18 Pages.
PCT International Search Report and Written Opinion, PCT Application No. PCT/US2017/064351, dated Apr. 9, 2018, 25 Pages.
PCT Invitation to Pay Additional Fees, PCT Application No. PCT/US2017/064361, dated Mar. 7, 2018, 18 Pages.
PCT Invitation to Pay Additional Fees, PCT Application No. PCT/US2017/064292, dated Mar. 5, 2018, 15 Pages.
PCT International Search Report and Written Opinion, PCT Application No. PCT/USS2017/068255, dated Mar. 19, 2018, 14 Pages.
European Patent Office, Communication Pursuant to Article 94(3) EPC for European Patent Application No. EP 14748326.7, dated Feb. 15, 2018, 7 Pages.
European Patent Office, Supplementary European Search Report for European Patent Application No. 15810847.2, dated Feb. 28, 2018, 19 Pages.
European Patent Office, Extended European Search Report, European Patent Application No. EP 15812324.0, dated Feb. 21, 2018, 23 Pages.
European Patent Office, Extended European Search Report, European Patent Application No. EP 15809264.3, dated Mar. 12, 2018, 14 Pages.
Intellectual Property Australia, Examination Report No. 1 for Australian Patent Application No. AU 2017201009, dated Apr. 4, 2018, 3 Pages.
New Zealand Intellectual Property Office, Further Examination Report, New Zealand Patent Application No. 726116, dated Feb. 27, 2018, 6 Pages.
Ukraine Patent Office, Office Action for Ukrainian Patent Application No. a201508515, dated Feb. 20, 2018, 9 Pages (with English translation).
Office Action for Israel Patent Application No. IL 255682, dated Mar. 15, 2018, 2 Pages (Translation).
Office Action for Israel Patent Application No. IL 255684, dated Mar. 19, 2018, 2 Pages (Translation).

(56) References Cited

OTHER PUBLICATIONS

Office Action for Israel Patent Application No. IL 255685, dated Mar. 20, 2018, 2 Pages (Translation).
Office Action for Israel Patent Application No. IL 255688, dated Mar. 22, 2018, 2 Pages (Translation).
Abdellatif, L., et al., "Characterization of virulence and PCR-DGGE profiles of Fusarium avenaceum from western Canadian Prairie Ecozone of Saskatchewan,"Canadian Journal of Plant Pathology, 2010, pp. 468-480.
Abou-Shanab, R.A., et al: "Characterization of Ni-resistant bacteria in the rhizosphere of the hyperaccumulator Alyssum murale by 16S rRNA gene sequence analysis", World Journal of Microbiology and Biotechnology, vol. 26, No. 1, Aug. 15, 2009, pp. 101-108.
Amatuzzi, R.F., et al., "Univers1dade Federal Do Parana," Jan. 1, 2014, 52 Pages (With English Abstract).
Amatuzzi, R.F., et al., "Potential of endophytic fungi as biocontrol agents of Duponchelia fovealis (Zeller) (Lepidoptera:Crambidae)," Brazilian Journal of Biology, Nov. 9, 2017, 7 Pages.
Bethlenfalvay, G., et al., "Mycorrhizal fungi effects on nutrient composition and yield of soybean seeds", Journal of Plant Nutrition, vol. 20, No. 4-5, Apr. 1, 1997, pp. 581-591.
NCBI GenBank: CP000653.1 "*Enterobacter* sp. 638, complete genome" Jan. 28, 2014, 5 Pages, Can be retrieved at <URL:https://www.ncbi.nlm.nih.gov/nuccore/CP000653.1>.
NCBI GenBank: CP000653.1 "*Enterobacter* sp. 638, complete genome" ASM1632v1, Apr. 18, 2007, 2 Pages, Can be retrieved at <URL:https://www.ncbi.nlm.nih.gov/assembly/GCA_000016325.1>.
NCBI GenBank: EU340965.1 "*Enterobacter* sp. 638 16S ribosomal RNA gene, partial sequence" Jan. 30, 2009, 1 Page, Can be retrieved at <URL:https://www.ncbi.nlm.nih.gov/nuccore/EU340965.1>.
NCBI GenBank: EBI accession No. EM STD:JQ759988, "*Dothideomycetes* sp. genotype 226 isolate FL0175 internal transcribed spacer 1, partial sequence; 5.85 ribosomal RNA gene and internal transcribed spacer 2, complete sequence; and 28S ribosomal RNA gene, partial sequence," May 17, 2012, 1 Page.
NCBI GenBank: EBI accession No. EM STD:GU055658, "Uncultured Periconia clone NG R 806 18S ribosomal RNA gene, partial sequence; internal transcribed spacer 1, 5.8S ribosomal RNA gene, and internal transcribed spacer 2, complete sequence; and 28S ribosomal RNA gene, partial sequence," Oct. 27, 2009, 1 Page.
Database Geneseq Database accession No. BAP97938 "Pantoea dispersa strain KACC91642P 16S rDNA sequence, SEQ ID 1." Aug. 15, 2013, 1 Page.
Hamayun, M., et al., "*Cladosporium sphaerospermum* as a new plant growth-promoting endophyte from the roots of *Glycine max* (L.) Merr," World Journal of Microbiology and Biotechnology, Kluwer Academic Publishers, Feb. 15, 2009, pp. 627-632, vol. 25, No. 4.
Klaubauf, S., et al., "Molecular diversity of fungal conmunities in agricultural soils from Lower Austria," Fungal Diversity, Aug. 13, 2010, pp. 65-75, vol. 44, No. 1.
Knapp, D., et al., "Inter- and intraspecific functional diversity of fungal root endophytes of semiarid sandy grasslands," Acta Microbiologica et Immunologica Hungarica, Nov. 2017, pp. 1-101, vol. 64, Issue Supplement 1.
Kumar, A., et al., "Bio-control potential of *Cladosporium* sp. (MCPL-461), against a noxious weed *Parthenium hysterophorus* L.," J. Environ Biol., Mar. 2009, pp. 307-312, vol. 30, Issue 2.
Kusari, S., et al. "Chemical ecology of endophytic fungi: origins of secondary metabolites," Cell Press, Chem & Biol., 2012, pp. 792-798, vol. 19.
Mandyam, K., et al., "Mutualism-parasitism paradigm synthesized from results of root-endophyte models", Frontiers in Microbiology, Jan. 12, 2015, pp. 1-14, vol. 5.
Rae, R., et al., "A subset of naturally isolated Bacillus strains show extreme virulence to the free-living nematodes *Caenorhabditis elegans* and *Pristionchus pacificus*", Environmental Microbiology, 2010, pp. 3007-3021, vol. 12, No. 11.

Samways, M.J., et al., "Assessment of the Fungus *Cladosporium oxyspoum* (Berk. and Curt.) as a Potential BioControl Agent Against Certain Homoptera," Elsevier Science Publioshers B.V., Jan. 1, 1986, pp. 231-239.
Saunders, M., et al., "Host-Synthesized Secondary Compounds Influence the In Vitro Interactions between Fungal Endophytes of Maize", Applied and Environmental Microbiology, Nov. 9, 2007, pp. 136-142, vol. 74, No. 1.
Shiraishi, A., et al., "Nodulation in black locust by the ammaproteobacteria *Pseudomonas* sp. and the Betaproteobacteria *Burkholderia* sp", Systematic and Applied Microbiology, Aug. 2010, pp. 269-274, vol. 33, No. 5.
Simola, L., et al., "The Effect of Some Protein and Non-Protein Amino Acids on the Growth of Cladosporium herbarum and Trichotheeium roseum," Effect of Amino Acids on Fungi, Physiologia Plantarum, 1979, pp. 381-387, vol. 46.
Taghavi, S., et al., "Genome Sequence of the Plant Growth promoting Endophytic Bacterium *Enterobacter* sp. 638", PLoS Genet., May 2010, pp. 1-15, vol. 6, Issue 5, e1000943.
U'Ren, J.M., et al., "Host and geographic structure of endophytic and endolichenic fungi at the continental scale," American Journal of Botany, May 1, 2012, pp. 898-914, vol. 99, No. 5.
Valencia, E., et al., "Mini-review: Brazilian fungi diversity for biomass degradation," Fungal Genetics and Biology, 2013, pp. 9-18, vol. 60.
Vujanovic, V., et al., "Viability Testing of Orchid Seed and the Promotion of Colouration and Germination," Annals of Botany, Mar. 17, 2000, pp. 79-86, vol. 86.
Vujanovic, V., et al., "Endophytic hyphal compartmentalization is required for successful mycobiont-wheat interaction as revealed by confocal laser microscopy," The proceedings of the Soils and Crops conference in Saskatoon (2008) published 2009, 7 Pages.
Vujanovic, V., et al., "Mycovitality—a new concept of plant biotechnology," Canadian Journal Plant Pathol, 2007, vol. 29, p. 451.
Vujanovic, V., et al., "Seed endosymbiosis: a vital relationship in providing prenatal care to plants," Can. J. Plant Sci., NRC Research Press, Feb. 6, 2017, pp. 972-981, vol. 97.
Youssef, Y.A., et al., "Production of Plant Growth Substances by Rhizosphere Myoflora of Broad Bean and Cotton," Biologia Plantarum, 1975, pp. 175-181, vol. 17, No. 3.
European Patent Office, Supplementary European Search Report, European Patent Application No. 13874703.5, dated Jun. 21, 2016, 3 Pages.
Invitation to Pay Additional Fees, PCT Application No. PCT/US2015/038187, dated Oct. 14, 2015, 5 Pages.
Soe, K.M, et al, "Evaluation of effective Myanmar Bradyrhizobium strains isolated from Myanmar soybean and effects of coinoculation with Streptomyces griseoglavus P4 for nitrogen fixation", Soil science and plant nutrition 593 (2013): 361-370 (Year: 2013).
Ngom, A et al., "A novel symbiotic nitrogen-fixing member of the Ochrobactrum clade isolated from root nodues of Acacia mangium". J. Gen. Appl. Microbiol. (2004) 50: 17-27.
Trujillo, M.E et al., "Nodulation of Lupinus albus by strins of *Ochrobactrum lupini* sp. nov." Appl. Environ Microbiol Mar. 2005; 71(3): 1318-1327.
Bal, H.B et al., "Isolation of ACC deaminase producing PGPR from rice rhizosphere and evaluating their plant growth promoting activity under salt stress". Plant Soil (2013) 366: 93-105 doi: 10/1007/s11104-012-1402-5.
Chakraborty et al., "Evaluation of Ochrobactrum anthropi TRS-2 and its talcbased formulation for enhancement of growth of tea plants and management of brown root rot disease." Journal of Applied Microbiology, 2009, 107(2):625-634 DOI:10.1111/j.1365-2672.2009.04242.x <https://doi.org/10.1111/j.1365-2672.2009.04242.x.
Sulistiyani, et al., "Population and Diversity of Endophytic Bacteria Associated with Medicinal Plan *Curumma zedoaria*", Microbiology Indonesia 8.2 (2014):4.
GenBank Accession No. KJ152029, May 6, 2015.
GenBank Accession No. KJ162248, Apr. 8, 2014.
Goudjal, Y., et al., "Biocontrol of Rhizoctonia solani damping-off and promotion of tomato plant growth by endophytic actinomycetes

(56) References Cited

OTHER PUBLICATIONS isolated from native plants of Algerian Sahara", Microbiological Research, 2014, vol. 169, No. 1, pp. 59-65.
Govindarajan, M. et al., "Effects of the Inoculation of Burkholderia vietnamensis and Related Endophytic Diaztrophic Bacteria on Grain Yield of Rice", Microbiol Ecology, Apr. 4, 2007, 17 Pages.
Guo, X., et al., "Red Soils Harbor Diverse Culturable Actinomycetes That Are Promising Sources of Novel Secondary Metabolites", Applied and Environmental Microbiology, Feb. 27, 2015, vol. 81, No. 9, pp. 3086-3103.
Iverson, C., et al, "The taxonomy of Enterobacter sakazakii: proposal of a new genus *Cronobacter* gen. nov. and descriptions of *Cronobacter sakazakii* comb. nov. *Cronobacter sakazakii* subsp. *sakazakii*, comb. nov., *Cronobacter sakazakii* subsp. *malonaticus* subsp. nov., *Cronobacter turicensis* sp. nov., *Cronobacter muytjensii* sp. nov., *Cronobacter dublinensis* sp. nov. and *Cronobacter* genomospecies I", BMC Evolutionary Biology 2007, Apr. 17, 2017, 11 pages.
Joe, M.M. et al., "Development of alginate-based aggregate inoculants of *Methylobacterium* sp. and Azospirillum brasilense tested under in vitro conditions to promote plant growth," Journal of Applied Microbiology 2013, 116(2):408-423, XP055225426, Nov. 22, 2013.
Manoharan, M. J. et. al., "Survival of flocculated cells in alginate and its inoculatin effect on growth and yield of maize under water deficit conditions," EPJ of Soil Biology, Gauthier-Villars, Montrouge, FR, vol. 50, Mar. 7, 2012, pp. 198-206, XP028421147.
Murali, Gopal, et al., "Microbiome Selection Could Spur Next-Generation Plant Breeding Strategies," Frontiers in Microbiology, vol. 7, Dec. 7, 2016, XP055531064.
Orakçi GE et al, "Selection of antagonistic actinomycete isolates as biocontrol agents against root-rot fungi", Fresenius Environmental Bulletin, 2010, 19: 417-424 & GenBank Accession No. GQ475299, Oct. 5, 2009.
"Sequence Alignment of JQ047949 with Instant SEQ ID No: 2," Search conducted on Jan. 2, 2019, 2 pages.
Wang, L. et al. Application of Bioorganic Fertilizer Significantly Increased Apple Yields and Shaped Bacterial Community Structure in Orchard Soil.
Whelehan, et al., "Microencapsulation using vibrating technology," Journal of Microencapsulation 2011, vol. 28(8), pp. 669-688.
Yashiro et al., "Effect of Streptomycin Treatment on Bacterial Community Structure in the Apple Phyllosphere," PLOS ONE, May 21, 2012, vol. 7, No. 5, 10 pages.
Zhao, Jun, et al., "Effects of organic-inorganic compound fertilizer with reduced chemical fertilizer application on crop yields, soil biological activity and bacterial community structure in a rice-wheat cropping system," Applied Soil Ecology, vol. 99, Nov. 28, 2015, pp. 1-12, XP055530937.
PCT International Search Report and Written Opinion for PCT/AU2018/050387, dated Jul. 12, 2018, 8 pages.
PCT International Search Report and Written Opinionfor PCT/US2018/051467, dated Mar. 25, 2019 26 pages.
Hanshew, A., et al., "Characterization of Actinobacteria Associated with Three Ant-Plant Mutualisms", Microbiol Ecology, Aug. 6, 2014, vol. 69, No. 1, pp. 192-203.
Langille, M.G.I. et al., "Predictive functional profiling of microbial communities using 16S rRNA marker; gene sequences," Nature Biotechnology, 2013, vol. 31, No. 9, pp. 814-821.
Invitation to Pay Additional Fees, PCT Application No. PCT/CA2013/000091, dated Mar. 27, 2013, 2 Pages.
International Search Report and Written Opinion for PCT/EP2013/062976, dated Dec. 22, 2014, 9 Pages.
International Search Report and Written Opinion, Application No. PCT/US2014/054160, dated Dec. 9, 2014, 21 Pages.
Invitation to Pay Additional Fees, PCT Application No. PCT/US2014/064411, dated Feb. 5, 2015, 2 Pages.
International Search Report and Written Opinion, International Application No. PCT/US2014/064411, dated Mar. 27, 2015, 15 Pages.

International Search Report and Written Opinion, International Application No. PCT/US2014/072399, dated Jun. 26, 2015, 22 Pages.
Invitation to Pay Additional Fees, PCT Application No. PCT/US2014/072400, dated Apr. 16, 2015, 6 Pages.
International Search Report and Written Opinion, Application No. PCT/US2014/072400, dated Jul. 8, 2015, 38 Pages.
Invitation to Pay Additional Fees, PCT Application No. PCT/US2015/038110, dated Sep. 22, 2015, 8 Pages.
NCBI GenBank: Accession No. XP55670271, "*Enterobacter* sp. MLB05 16S ribosomal RNA gene, partial sequence—Nucleotide", Jun. 9, 2012, 1 Page, can be retreived at URL:https://www.ncbi.nlm.nih.gov/nuccore/J Q765415.1/.
NCBI GenBank: Accession No. XP55670274, "*Enterobacter* sp. CR 6-3 16S ribosomal RNA gene, partial sequence—Nucleotide", Mar. 27, 2013, 1 Page, can be retreived at URL:https://www.ncbi.nlm.nih.gov/nuccore/K C355340.
NCBI GenBank: Accession No. XP55670279, "Uncultured bacterium clone bb2s4 16S ribosomal RNA gene, partial seque—Nucleotide", May 6, 2005, 1 Page, can be retreived at URL:https://www.ncbi.nlm.nih.gov/nuccore/D Q068880.
Result 11 from a search in the GenEmbl database, GenEmbl Record No. EU 977189, Smith et al., "Bioactive endophytes warrant intensified exploration and conservation," PLoS ONE 3(8):E3052, 2008.
Result 3 from a search in the GenEmbl database, GenEmbl Record No. KF011597, Paenibacillus strain No. HA13, Park et al., "Isolation and characterization of humic substances-degrading bacteria from the subarctic Alaska grasslands," J Basic Microbiol, 2013.
PCT International Search Report and Written Opinion for PCT/US2018/051467, dated Feb. 4, 2019, 22 pages.
Chaves, J., et al., "Identification and Phylogeny of Streptomyces Based on Gene Sequences", Research Journal of Microbiology, vol. 13, No. 1, Dec. 15, 2017, pp. 13-20, XP055675917.
Girard, G., et al., "A novel taxonomic marker that discriminates between morphologically complex actinomycetes", Open Biology, vol. 3, No. 10, Oct. 2013, p. 130073,XP055675916.
Guo, Y., et al. "A multi locus phylogeny of the Streptomyces griseus 16S rRNA gene clade: use of multilocus sequence analysis for streptomycete systematics", International Journal of Systematic and Evolutionary Microbiology, vol. 58, No. 1, 2008, pp. 149-159, XP055675936.
PCT International Search Report and Written Opinion PCT/AU2018/050387, dated Jul. 12, 2018 (Filing date is Apr. 27, 2018).
Bentley, S.D., et al, Complete genome sequence of the model actinomycete *Streptomyces coelicolor* A3(2), Nature. May 9, 2002;417(6885):141-7. (Year 2002).
Gabor, J., et al., "Mycorrhizal fungi effects on nutrient composition and yield of soybean seeds," Journal of Plant Nutrition, 20:4-5, 581-591, 1997.
Gopalakrishnan, S. et al., "Plant growth-promoting activities of *Streptomyces* spp. in sorghum and rice", SpringerPlus, 2/1/574, pp. 1-8, http://www.springerplus.com/content/2/1/574, 2013.
Groppe, K., et al., "Interaction between the endophytic fungus *Epichloë bromicola* and the grass *Bromus erectus*: effects of endophyte infection, fungal concentration and environment on grass growth and flowering," Mol Ecol., 8:1827-1835, 1999.
Hubbard, M., "Fungal Endophytes that Confer Heat and Drought Tolerance to Wheat," Doctoral dissertation, University of Saskatchewan, 2012.
Ikeda, H., et al., "Complete genome sequence and comparative analysis of the industrial microorganism *Streptomyces avermitilis*," Nat Biotechnol. May 2003;21 (5) :526-31. Epub Apr. 14, 2003 (Year 2003).
Lee, J., et al., "*Streptomyces koyangensis* sp. nov., a novel actinomycete that produces 4-phenyl-3-butenoic acid," Int J Syst Evol Microbial. Jan. 2005;55(Pt 1):257-62. (Year 2005).
Lind, A., et al., "Drivers of genetic diversity in secondary metabolic gene clusters within a fungal species", PLOS Biology, Nov. 17, 2017, 26 pages.
Pacovsky, R., "Carbohydrate, protein and amino acid status of Glycine-Glomus-Bradyrhizobium symbioses," Physiologia Pantarium; 75:346-354, 1989).

(56) References Cited

OTHER PUBLICATIONS

Sha, T. et al., "Genetic diversity of the endemic gourmet mushroom *Thelephora ganbajun* from southwestern China", Microbiology (2008), 154, 3460-3468.

Sugita, T. et al., "Intraspecies Diversity of *Cryptococcus laurentii* as Revealed by Sequences of Internal Transcribed Spacer Regions and 28S rRNA Gene and Taxonomic Position of *C. laurentii* Clinical Isolates", Journal of Clinical Microbiology, Apr. 2000, p. 1468-1471.

Wiebold, M., et al., "Agriculture Experiment Station, College of Agriculture, Food & Natural Resources, University of Missouri, Special Report 589, pp. 1-124).".

* cited by examiner (a)

(b)

(c)

(a)

(b)

(c)

A)

B)

C)

A)

B)

C)

| Rep 3 | Border | V3 1624 | V1 1625 | V2 1626 | Border |
| Rep 2 | Border | V2 1621 | V3 1622 | V1 1623 | Border |
| Rep 3 | Border | V1 1618 | V2 1619 | V3 1620 | Border |

A)

B)

A)

B)

C)

METHOD FOR PROPAGATING MICROORGANISMS WITHIN PLANT BIOREACTORS AND STABLY STORING MICROORGANISMS WITHIN AGRICULTURAL SEEDS

RELATED APPLICATION DATA

This application is a continuation of U.S. application Ser. No. 15/107,965 filed Jun. 24, 2016 (allowed), which is the National Stage of International Application No. PCT/US2014/072400, filed Dec. 24, 2014, which claims priority to the following applications: International Application No. PCT/US2014/054160 filed Sep. 4, 2014; Provisional Application No. 62/017,796, filed Jun. 26, 2014; Provisional Application No. 62/017,809, filed Jun. 26, 2014; Provisional Application No. 62/017,813 filed Jun. 26, 2014; Provisional Application No. 62/017,815 filed Jun. 26, 2014; Provisional Application No. 62/017,816 filed Jun. 26, 2014; Provisional Application No. 62/017,818 filed Jun. 26, 2014; International Application No. PCT/US2014/044427 filed Jun. 26, 2014; and Provisional Application No. 61/920,560 filed Dec. 24, 2013; and is a continuation of U.S. application Ser. No. 14/315,804 filed Jun. 26, 2014, now U.S. Pat. No. 9,364,005. Each application is herein incorporated in its entirety by reference.

SEQUENCE LISTING

The instant application contains a Sequence Listing which has been filed electronically in ASCII format and is hereby incorporated by reference in its entirety. Said ASCII copy, created on Jul. 2, 2019, is named 28412USC1_PCT_sequencelisting.txt and is 2,453,823 bytes in size.

BACKGROUND

Since the biotechnology revolution, there has been a desire to grow a diversity of microbes in low-cost, simple, and scalable culture systems. There has also been a need to generate shelf-stable formulations that can allow low-cost storage of valuable microbes.

SUMMARY OF THE INVENTION

The present invention relates to methods of scalably producing microorganisms by propagating them within plant tissues and introducing them into agricultural seeds to improve their shelf-life during long-term storage.

The present invention is based on the surprising discovery that microbes can be viably incorporated into the seeds of plants by inoculation of various plant tissues. The inventors have discovered that, when a preparation of microorganisms is applied to a plant under select conditions, the microorganisms can gain entry when grain formation starts and establish populations inside, and hence colonize the seed. The methods described herein can be used to introduce new microbes into plants and their seeds as a means of supporting the scalable expansion and storage of the desired microbe. The methods also can produce plants and seeds that uniformly comprise desired microbes and microbial products. These methods can be used to generate plants with valuable microbial constituents that can be difficult to produce with current lab or industrial cultivation methods and can produce seeds comprising microbes in a form that allows the microbe's storage for prolonged periods at room temperature. Also provided are novel compositions of plants, plant parts and seeds containing microbes.

In some aspects, disclosed herein is a method of generating a bacterial endophyte library, comprising the steps of providing an inoculum comprising a plurality of bacterial endophyte entities, contacting the inoculum with a cereal plant seed, wherein the cereal plant seed is substantially depleted of surface endophytes, under conditions such that at least two bacterial endophyte entities present in the inoculum are incorporated into a cereal plant grown or derived from the plant seed, such that a bacterial endophyte library is generated within the cereal plant at a concentration of 106 CFU per plant. In certain embodiments, the at least two bacterial endophyte entities are exogenous to the cereal plant seed. In some embodiments, the bacterial endophyte library comprises at least three bacterial endophyte entities. In some embodiments, the bacterial endophyte library comprises at least five bacterial endophyte entities. In some embodiments, the bacterial endophyte library comprises at least ten bacterial endophyte entities. In some embodiments, the bacterial endophyte library comprises at least one bacterial entity not detectably present in the cereal plant seed. In other embodiments, the at least two bacterial endophyte entities comprise a first bacterial endophyte entity exhibiting a first phenotype and a second bacterial endophyte entity exhibiting a second phenotype.

In certain embodiments, the first and second phenotypes are selected from catalase activity, oxidase activity, casein hydrolysis activity, gelatin hydrolysis activity, ACC-deaminase activity, exopolysaccharide activity, amylase activity, cellulase activity, chitinase activity, hemolytic activity, lipase activity, pectinase activity, phosphatase activity, protease activity, xylanase activity, production of an auxin, production of an antimicrobial, production of HCN, production of NH3, production of AHL, production of PHB, production of a siderophore, mineral phosphate solubilization, and production of acetoin.

In some embodiments, the method further comprises the steps of planting a plurality of the cereal plant seeds and allowing the plants to grow, wherein the bacterial endophyte is present at $10^{10}$ CFU per acre of plants planted according to established agricultural practices. In further embodiments, at least one of the bacterial endophyte entities is capable of using methanol or ethanol as their main carbon source. In some aspects, disclosed herein is a seed preparation comprising the bacterial endophyte library disclosed above, disposed on a plurality of seeds.

In other aspects, disclosed herein is a method of producing an endophyte population in a bioreactor, comprising introducing into a bioreactor comprising a cereal plant material at least one bacterial endophyte entity, wherein the bacterial endophyte entity is localized an to an intercellular space of the cereal plant material, under conditions such that the bacterial endophyte entity proliferates within the intercellular space, thereby producing an endophyte population within the bioreactor. In some embodiments, the cereal plant material comprises a root. In some embodiments, the bacterial endophyte is selected from Table 10. In some embodiments, the cereal plant material comprises a shoot. In some embodiments, the bacterial endophyte is selected from Table 11. In some embodiments, the cereal plant material comprises a seed. In some embodiments, the bacterial endophyte is selected from Table 12. In other aspects, disclosed herein is a synthetic combination comprising the bioreactor and the endophyte population.

In further aspects, disclosed herein is a method of endophyte propagation comprising the steps of providing an inoculum comprising one or a plurality of bacterial endophyte entities of Table 1, contacting the inoculum with a cereal plant seed, cereal plant seedling, or a cereal plant, under conditions such that at least one bacterial endophyte entity present in the inoculum is incorporated into a cereal plant grown or derived from the cereal plant seed, cereal plant seedling, or cereal plant, wherein the at least one bacterial endophyte entity is propagated within the cereal plant. In some embodiments, the at least one bacterial endophyte entity comprises a bacterial endophyte entity exogenous to the grown cereal plant.

In further aspects, disclosed herein is a method for archiving an endophyte population, comprising the steps of: a) providing an isolated endophyte population, b) contacting the provided isolated endophyte population with a cereal plant seed under conditions that an endophyte population comprising a plurality of bacterial endophyte entities are present in an intercellular space of a cereal plant grown or derived from the cereal plant seed, c) providing conditions that permit the endophyte to grow and divide in the inoculated agricultural plant, and d) isolating one or more seeds from the grown cereal plant, wherein the seeds comprise the isolated endophyte population, thereby archiving the endophyte population within the isolated one or more seeds. In some embodiments, the endophyte population has enhanced stability relative to an unarchived endophyte. In other embodiments, the endophyte population is exogenous to the cereal plant seed. In further embodiments, the endophyte population is present in a substantially anhydrous state. In other embodiments, the endophyte population is present in a substantially anaerobic state. In some embodiments, the endophyte population is substantially resistant to at least one biotic stress. In some embodiments, the endophyte population is substantially resistant to at least one abiotic stress. In certain embodiments, the endophyte population comprises at least about $1 \times 10^3$ endophytes. In some embodiments, the endophyte population is propagated in culture. In some embodiments, the endophyte population is unamplified by propagation in culture. In some embodiments, the endophyte population is propagated in cereal plants. In some embodiments, the endophyte population comprises a first bacterial endophyte entity isolated from a plant selected from corn, wheat, soy, cotton, rice, and canola. In some embodiments, the endophyte population comprises a first bacterial endophyte entity isolated from a plant selected from soy, cotton and canola. In some embodiments, the endophyte population comprises a first bacterial endophyte entity isolated from a plant environment selected from root, shoot, seed, and rhizosphere. In certain embodiments, the plant environment is root and the endophyte is selected from Table 10. In certain embodiments, the plant environment is shoot and the endophyte is selected from Table 11. In certain embodiments, the plant environment is seed and the endophyte is selected from Table 12. In certain embodiments, the plant environment is endosphere and the endophyte is selected from Table 13.

In further aspects, disclosed herein is a method of propagating a bacterial endophyte, comprising: a) providing a bacterial endophyte preparation that is isolated from a host plant or the environment thereof, wherein the bacterial endophyte is capable of growing and dividing in a recipient agricultural plant, b) contacting the recipient plant with the bacterial endophyte preparation to produce an inoculated agricultural plant, c) providing conditions that permit the endophyte to grow and divide in the inoculated agricultural plant, and d) isolating inoculated agricultural plant seeds produced from the inoculated agricultural plant, wherein the agricultural plant seeds contain the endophyte and progeny thereof, thereby propagating the bacterial endophyte. In some embodiments, the bacterial endophyte is not cultured. In certain embodiments, the method comprises repeating steps a)-d) one or more times to generate a sufficient quantity of agricultural seeds to populate a field. In some embodiments, the bacterial endophyte population comprises a plurality of bacterial entities. In other embodiments, the method further comprises planting the inoculated agricultural plant seeds.

In further aspects, disclosed herein is a method of protecting an endophyte, comprising the steps of a) providing an endophyte preparation that is isolated from a host plant or the environment thereof, wherein the endophyte is capable of growing and dividing in a recipient agricultural plant, and wherein the endophyte is susceptible to a biotic or an abiotic stress, b) contacting the recipient plant with the endophyte preparation to produce an inoculated agricultural plant, c) providing conditions that permit the endophyte to grow and divide in the inoculated agricultural plant, d) isolating inoculated agricultural plant seeds produced from the inoculated agricultural plant, wherein the agricultural plant seeds contain the endophyte and progeny thereof, and e) storing the isolated agricultural plant seeds, thereby protecting the endophyte.

In additional aspects, disclosed herein is a method of generating a population of agricultural seed-endophyte combinations, comprising a. producing an agricultural seed comprising an endophyte, by the method comprising i) obtaining a first agricultural plant, ii) contacting the first agricultural plant with an endophyte preparation such that a first endophyte present in the endophyte preparation is incorporated into a first agricultural seed derived from the first agricultural plant; and b. producing from the first agricultural seed a second agricultural plant, under conditions such that a population of agricultural seed-endophyte combinations is generated.

In other aspects, disclosed herein is a method of generating a microbial endophyte library, comprising the steps of providing an inoculum comprising a plurality of microbial endophyte entities, contacting the inoculum with a part of a plant under conditions such that at least two microbial endophyte entities present in the inoculum are incorporated into the plant, such that a microbial endophyte library is generated within a seed derived from the inoculated plant. In some embodiments, the seed comprises at least 10, 100, 1000, or at least 10,000 CFU/seed of each of the microbial endophyte of the inoculum. In other embodiments, the plant is a cereal plant. In yet other embodiments, the microbial endophyte is a fungus or a bacterium.

In further aspects, disclosed herein is a method of generating a microbial endophyte library, comprising the steps of contacting a plant seed with an inoculum comprising a plurality of microbial endophyte entities, wherein the resulting contacted seed comprises an endophyte belonging to a family selected from the group consisting of Microbacteriaceae, Chitinophagaceae, Bacillaceae, Planococcaceae, Clostridiaceae, Comamonadaceae, Oxalobacteraceae, Enterobacteriaceae, Pseudomonadaceae, Xanthomonadaceae and one or more of the microbial endophytes listed in Table 1, wherein the microbial endophyte entities present in the contacted seed are incorporated into a bioreactor plant grown or derived from the contacted plant seed, such that a microbial endophyte library is generated within the bioreactor plant. In some embodiments, the seed is a cereal plant seed. In certain embodiments, the contacted seed comprises two, three, four, five, six, seven, eight, nine, or ten microbial endophytes listed in Table 1. In other embodiments, the seed comprises at least 10, 100, 1000, or at least 10,000 CFU/seed of each of the microbial endophytes. In further aspects, disclosed herein is a library of microbial endophytes generated by any of the methods disclosed above.

In other aspects, disclosed herein is a library of microbial endophytes comprising in a plant seed one or more microbial endophytes belonging to a family selected from the group consisting of Microbacteriaceae, Chitinophagaceae, Bacillaceae, Planococcaceae, Clostridiaceae, Comamonadaceae, Oxalobacteraceae, Enterobacteriaceae, Pseudomonadaceae, Xanthomonadaceae and one or more microbial endophytes listed in Table 1.

In other aspects, disclosed herein is a library of microbial endophytes comprising in a bioreactor plant one or more microbial endophytes belonging to a family selected from the group consisting of Microbacteriaceae, Chitinophagaceae, Bacillaceae, Planococcaceae, Clostridiaceae, Comamonadaceae, Oxalobacteraceae, Enterobacteriaceae, Pseudomonadaceae, Xanthomonadaceae and one or more microbial endophytes listed in Table 1.

In other aspects, disclosed herein is a bioreactor plant produced by contacting a plant seed with an inoculum comprising a plurality of microbial endophyte entities, wherein the resulting contacted seed comprises an endophyte from the Enterobacteriaceae family and an endophyte from the Pseudomonadaceae family, and one or more of the microbial endophytes listed in Table 1, and wherein the microbial endophyte entities present in the contacted seed are incorporated into a bioreactor plant grown or derived from the contacted plant seed. In other aspects, disclosed herein is a bioreactor plant comprising one or more microbial endophytes belonging to a family selected from the group consisting of Microbacteriaceae, Chitinophagaceae, Bacillaceae, Planococcaceae, Clostridiaceae, Comamonadaceae, Oxalobacteraceae, Enterobacteriaceae, Pseudomonadaceae, Xanthomonadaceae and one or more microbial endophytes listed in Table 1. In other aspects, disclosed herein is a field comprising at least 1, 10, 100, 1000, 10000 or more bioreactor plants as disclosed above.

In other aspects, disclosed herein is a shelf-stable seed-based storage vessel comprising one or more microbial endophytes selected from the group belonging to a family selected from the group consisting of Microbacteriaceae, Chitinophagaceae, Bacillaceae, Planococcaceae, Clostridiaceae, Comamonadaceae, Oxalobacteraceae, Enterobacteriaceae, Pseudomonadaceae, Xanthomonadaceae and one or more microbial endophytes listed in Table 1.

In other aspects, disclosed herein is a shelf-stable seed-based storage vessel for microbial endophytes produced by contacting a plant seed with an inoculum comprising a plurality of microbial endophyte entities, wherein the resulting contacted seed comprises comprises an endophyte from the Enterobacteriaceae family and an endophyte from the Pseudomonadaceae family, and one or more of the microbial endophytes listed in Table 1, wherein the microbial endophyte entities present in the contacted seed are incorporated into a bioreactor plant grown or derived from the contacted plant seed, and wherein the bioreactor plant generates shelf-stable seed-based storage vessels comprising the incorporated microbial endophyte entities.

In some embodiments of the shelf-stable seed-based storage vessel disclosed above, the at least one of the microbial endophyte produces at least 1 CFU/storage vessel when recovered and cultivated after storage for at least 1 month, 2 months, 3 months, 6 months, or at least 1 year. In other embodiments, the storage vessel further comprises on the outside a control agent, a plant growth regulator, a fertilizer and/or a nutrient. In some aspects, disclosed herein is a storage container comprising the shelf-stable seed-based storage vessel as disclosed above. In some embodiments, the storage container comprises 10, 100, 1000, 10000, 100000 seed-based storage vessels.

In other aspects, disclosed herein is a method of producing a substance within a plant, comprising introducing into a bioreactor comprising a cereal plant material at least one bacterial endophyte entity, wherein the bacterial endophyte entity is localized an to an intercellular space of the cereal plant material and is capable of producing the substance, under conditions such that the bacterial endophyte entity proliferates within the intercellular space, thereby producing the substance. In some embodiments, the substance is an enzyme. In some embodiments, the enzyme is selected from the group consisting of a catalase, an oxidase, an ACC-deaminase, an amylase, a cellulose, a chitinase, a lipase, a pectinase, a phosphatase, a protease, and a xylanase. In other embodiments, the substance is an antimicrobial. In other embodiments, the substance is PHB.

DESCRIPTION OF THE FIGURES

FIG. 47, panel b depicts an alternative approach to observe plant bioreactor colonization by seed-origin endophytes by tagging the microbes with a kanamycin resistance and GFP containing plasmid. These microbes were coated onto unsterilized maize seed which was dryed in a 50 mL conical tube and stored at room temperature for a week before being planted in cups containing sterile sand in a greenhouse. After a week of growth, shoots and roots were macerated using bead beating, serially diluted to 10× and 1,000× before plating and colony counting under UV to determine green fluorescing CFUs per plant on TSA plates containing kanamycin. Control plant extracts were plated on kanamycin free agar and developed non-GFP containing colonies of several undescribed microbes.

Figure 50:
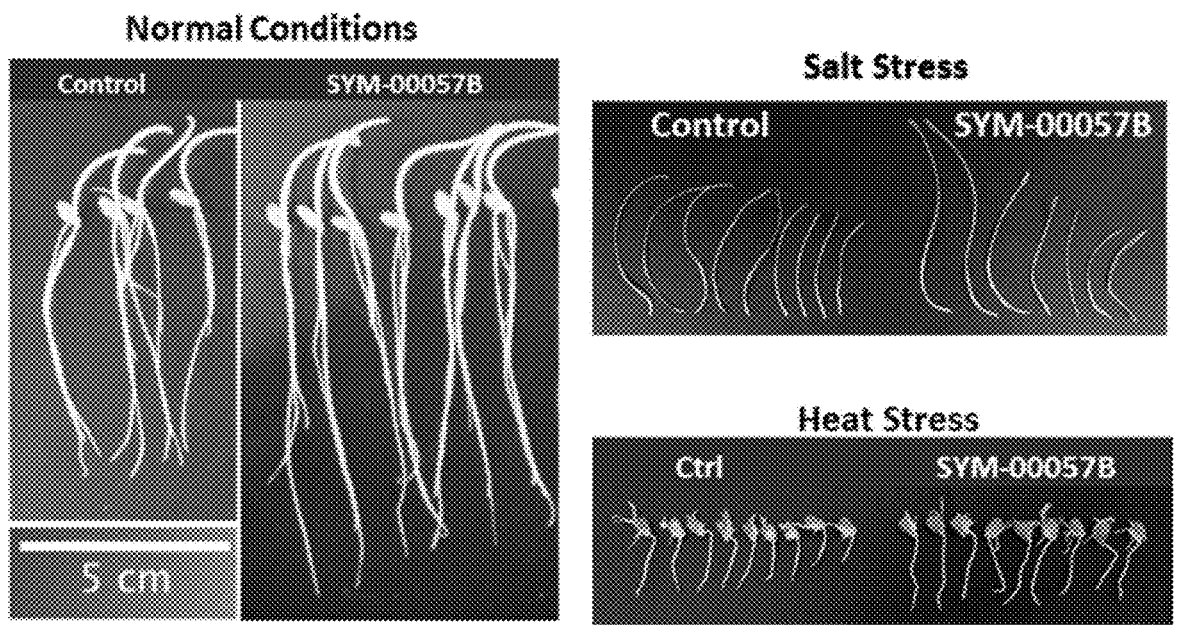

FIG. 50 contains representative photographs depicting seeds of wheat (Briggs cultivar) that were inoculated with the endophyte SYM00057B and grown under normal conditions (left), grown in the presence of 100 mM NaCl (top right), or under heat stress (bottom right). Increase in root length of wheat plant-based bioreactors inoculated with seed-borne endophytes.

Figure 51:
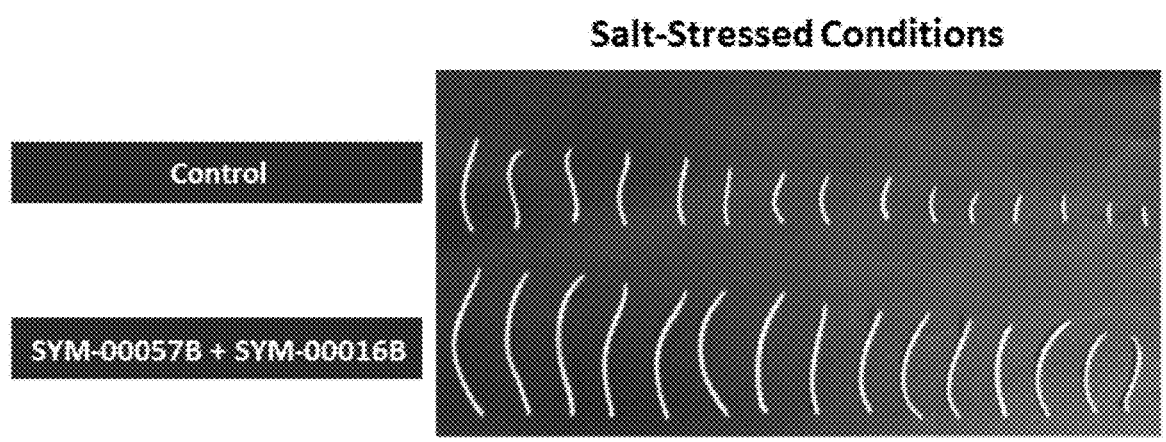

FIG. 51 contains representative photographs depicting wheat seeds inoculated with a combination of SYM00057B and SYM00016B (bottom row) show enhanced growth under salt stress conditions when compared with controls (top row). Combinations of seed-origin microbes confer improved vigor to wheat plant-based bioreactors.

Figure 52:
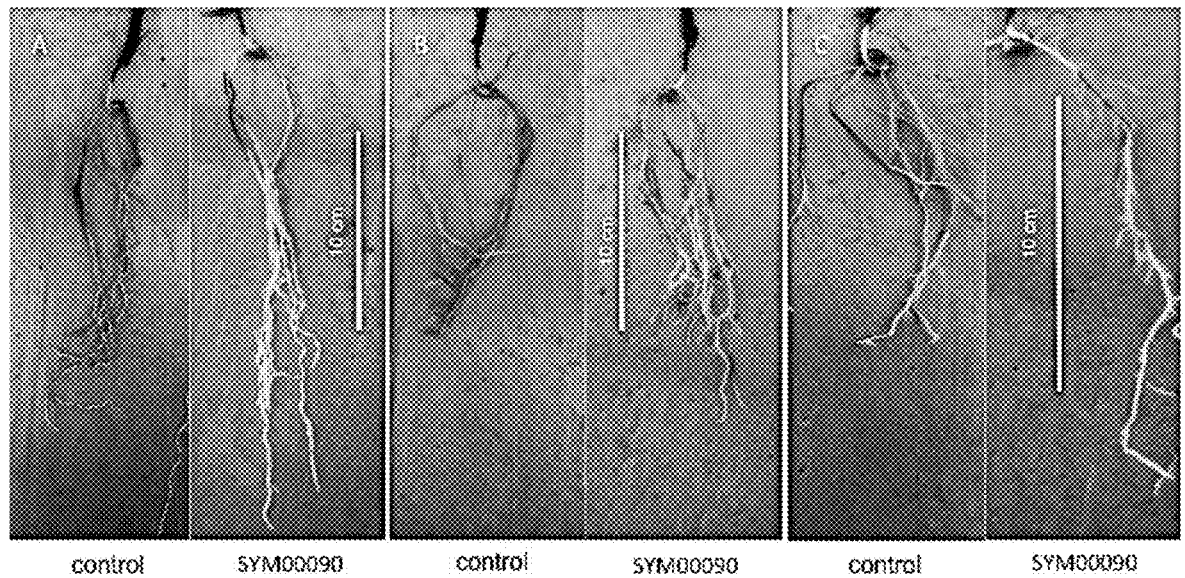

FIG. 52 contains representative photographs of roots of plants that germinated from uninoculated (control) and inoculated seeds (Sym00090) and were exposed to A) normal, B) drought and C) cold conditions. For normal conditions, plants were kept on a growth chamber set up to 22° C., 60% relative humidity and 14 h light/10 dark cycle for 15 days after planting. For drought, water was removed from bottom container in double-decker Magenta box one week after planting and the sand was let to dry. Harvesting was done at 7 days after water was removed, when wilting symptoms appeared. For cold, the air temperature was set to 5° C., one week after planting and maintained for 7 days. The roots of the inoculated plant-based bioreactors are not only larger but also show a larger amount of lateral roots and root-hairs.

Figure 53:
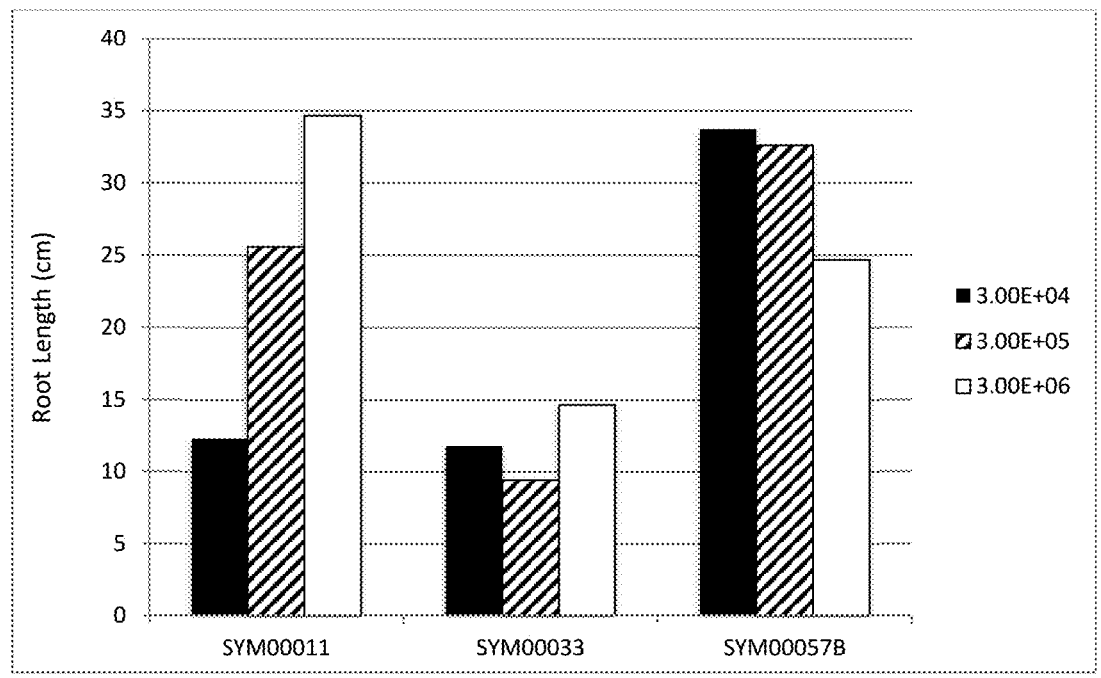

FIG. 53 is a graph depicting that seed-origin microbes can colonize plant-based bioreactors across a wide range of administered doses. Sterilized wheat seeds were inoculated with $3.0 \times 10^4$, $3.0 \times 10^5$ and $3.0 \times 10^6$ CFU/seed of endophytic microbes SYM00011, SYM00033 and SYM00057B. Shown are root lengths of each treatment, represented as a percentage increase over mock-inoculated controls.

Figure 54:
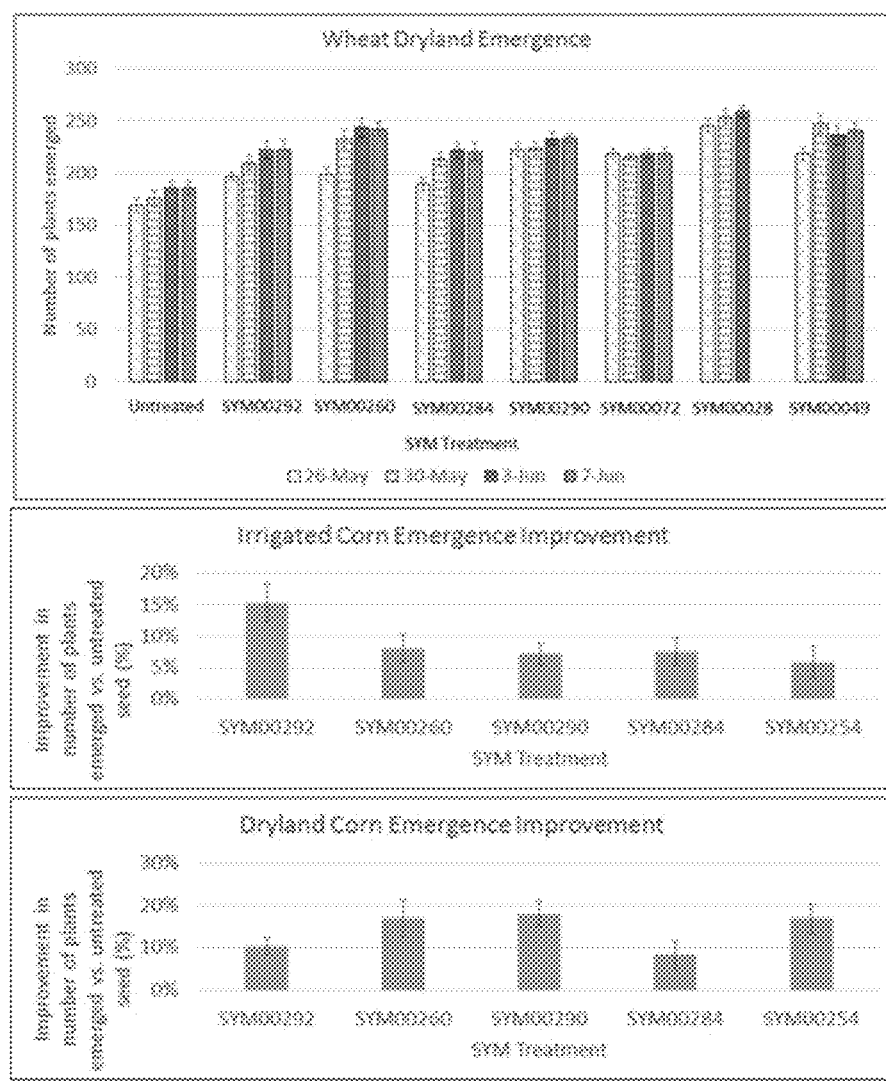

FIG. 54 contains three graphs depicting the field testing of microbially-innoculated plant-based bioreactors. Top panel: Number of wheat plants emerging in the middle 10' section of the middle 2 rows of each test plot. Numbers reported are an average of counts of 6 replicate plots for each treatment. All SYM strains show improvement in emergence over the untreated control. Middle panel: Improvement in the number of corn plants emerging in the dryland test plots over the untreated control. Emergence numbers were calculated as an average of counts of 6 replicate plots for each treatment. All SYM strains show improvement in emergence over the untreated control, with SYM00260, SYM00290 and SYM00254 all showing improvements greater than 15%. Bottom panel: Improvement in the number of corn plants emerged in the irrigated test plots over the untreated control. Emergence numbers were calculated as an average of counts of 6 replicate plots for each treatment. All SYM strains show improvement in emergence over the untreated control, with SYM00292 showing an improvement of 15%.

DETAILED DESCRIPTION OF THE INVENTION

Definitions

The term "endophyte" means—in its broadest meaning—the location of an organism, with "endo" means "inside" and "phyte" means "plants". An "endophyte" or "endophytic microbe" is an organism that lives within a plant or is otherwise associated therewith. Endophytes can occupy the intracellular or extracellular spaces of plant tissue, including the leaves, stems, flowers, fruits, seeds, or roots. An endophyte can be either a bacterial or a fungal organism that can confer a beneficial property to a plant such as an increase in yield, biomass, resistance, or fitness in its host plant. As used herein, the term "microbe" is sometimes used to describe an endophyte.

As used herein, the term "microbe" refers to a microorganism of bacterial or fungal origin. Therefore, the terms microbe and microorganism can be used interchangeably. As used herein, in certain embodiments, a microbe may be an endophyte. In other embodiments, a microbe may not be an endophyte.

In some embodiments, the invention contemplates the use of microbes that are "exogenous to the seed" of a plant or that are "exogenous to the plant". As used herein, a microbe is considered exogenous to the seed of a plant or to the plant if the seed or plant that is unmodified (e.g., a seed or plant that is not modified by the methods and compositions descried herein) does not contain the microbe (e.g. is not detectably present in the seed or plant). In some embodiments, an "exogenous" population of microbes includes those microbes present in a seed or plant in concentrations exceeding the native concentration.

In contrast, a microbe is considered to be "native" to a plant or a portion of the plant, and is said to be "natively" present in the plant or a portion of plant, if that plant or portion of the plant contains the microbe, for example, in the absence of any contacting with the microbe preparation. In some embodiments, an "endogenous" microbe is natively present in a plant or portion thereof.

"Not detectably present" as used herein means that an entity, e.g. a microbial endophyte, is not detected in a sample derived from, e.g. a seed, a plant, or the environment surrounding the plant (e.g. the soil) using standard methods of detection. That means that the entity is below the limit of detection of the apparatus or method used at the time of measurement.

As used herein, the term "substantially" or "substantial" refers, e.g., to the presence, level, or concentration of an entity in a particular space, and the effect of one entity on another entity. For example, an activity, level or concentration of an entity is substantially increased if the increase is 2-fold, 3-fold, 4-fold, 5-fold, 10-fold, 50-fold, 100-fold, or 1000-fold relative to a baseline. An activity, level or concentration of an entity is also substantially increased if the increase is 1%, 2%, 3%, 4%, 5%, 10%, 20%, 30%, 40%, 50%, 60%, 70%, 80%, 90%, 100%, 200%, or 500% relative to a baseline.

A "genetically modified plant" refers to a plant that contains genetic material not found in a wild-type plant of the same species, variety or cultivar and where the foreign genetic material has been constructed in the laboratory and been introduced using means other than genetic fertilization by pollen. The inserted genetic material usually comprising transgenes can be any DNA sequence and inserted into the host genome at random, or at specific locations by, for example, homologous recombination. Foreign DNA sequences can also be inserted into cells by transfer from one species into another following by chimeraplasty.

As used herein, the term "bioreactor plant" or "plant bioreactor" or "plant-based bioreactor" refers to a plant that is used to co-cultivate, maintain, store, or amplify one or more microbes described herein, such as, e.g. endophytic bacteria and/or *fungi*. A plant may be inoculated with one or more microbes and a plant tissue, including seeds that comprise the microbes may be harvested from the bioreactor plant.

As used herein, the term "variety" refers to a group of plants within a species that share constant characteristics that separate them from the typical form and from other possible varieties within that species.

As used herein, an "agricultural seed" is a seed used to grow a plant typically used in agriculture (an "agricultural plant"). The seed may be of a monocot or dicot plant, and may be planted for the production of an agricultural product, for example grain, food, fiber, etc. As used herein, an agricultural seed is a seed that is prepared for planting, for example, in farms for growing.

The present invention contemplates the use of "isolated" microbe. As used herein, an isolated microbe is a microbe that is isolated from its native environment, and carries with it an inference that the isolation was carried out by the hand of man. An isolated microbe is one that has been separated from at least some of the components with which it was previously associated (whether in nature or in an experimental setting). A isolated microbe is also separated from at least about 10%, 20%, 30%, 40%, 50%, 60%, 70%, 80%, 90%, 95%, 99% or greater than 99% of the other components with which the microbe was associated when produced. The term isolated further includes placing entities, such as, e.g. microbes, in a specific environment, e.g. for archiving or storage, such as placing the microbes into seed-based storage vessels. Such microbes are also considered isolated, e.g. if they were separated from, e.g. the leaves, stems, and roots of a bioreactor plant from which they were derived. Use of the term "entity" when describing a microbe, or "endophyte entity" refers to a microbe of a particular OTU, strain or taxa.

A "storage vessel", as used herein is a medium that is suitable for the storage and preservation (e.g. of viability) of plant-associated microbes. In some embodiments, the storage vessel is "seed-based." Seed-based storage vessels comprise a seed that may be obtained, e.g. from a bioreactor plant, the seed comprising one or more plant-associated microbes.

As used herein, a "reference agricultural plant" is an agricultural plant of the same species, strain, or cultivar to which a treatment or endophyte/microbe preparation is not administered/contacted. A reference agricultural plant, therefore, is substantially similar and is in some cases nearly identical or detectably identical to the microbe-associated plant (immediately prior to the association of the endophyte with the agricultural plant) with the exception of the presence of the microbe, and can serve as a control for detecting the effects of the microbe that is conferred to the plant and vice versa.

As used herein, the term "non-genomic nucleic acid content" refers to the content of non-chromosomal nucleic acids, and includes viral-encoded, plasmid-borne, episomal-borne nucleic acids, as well as signaling and regulatory RNA molecules, including microRNA, drRNA, and related RNA molecules.

Some of the methods described herein allow the colonization of plant seeds by microbes. As used herein, a microbe is said to "colonize" a plant or seed when it can exist in a symbiotic or non-detrimental relationship with the plant in the plant environment, for example on and/or inside a plant, including the seed.

As used herein, the "reproductive tissue" of a plant includes the tissues involved with reproduction, and includes any part of a flower including, but not limited to, the stamen, pistil, carpel, petal, ovule, ovary, anther, filament, stigma, sepal, receptacle, locule, peduncle, petal, and tassel.

As used herein, a "population of microbes" refers to a population of microbes (including endophyte populations) of common origin. In other words, a population of microbes refers to a population of cells that are genetically identical, or at least substantially identical.

The term "propagate", as used herein, means to grow or cultivate a population of cells.

As used herein, a "portion" of a plant refers to any part of the plant, and can include distinct tissues and/or organs, and is used interchangeably with the term "tissue" throughout.

As used herein, a plant or portion thereof that is "cured", or sterilized of an endogenous microbe is one in which substantially all, detectably all, or all of the endogenous microbes that reside within the plant or portion thereof is removed.

As used herein, a plant is deemed "intact" if the plant has not been physically compromised in any way, for example, by cutting, puncturing, or otherwise piercing the surface in a way that allows direct access to the internal portions of the plant.

As used herein, the term "progeny", in the context of describing a plant, denotes the offspring of any generation of a parent plant. Progeny of a plant, therefore, refers to generations of a plant, wherein the ancestry of the generation can be traced back to the plant. Likewise, the "progeny" of a microbe refers to the offspring of any generation of the microbe.

Microbes are deemed to be of "monoclonal origin" if the microbes are progeny of a common microbe.

A "viral entity", as used herein, refers to the detectable presence of a virus in a plant or portion thereof.

As used herein, a "purified" seed population refers to a selected group of seeds from a larger population, based on a given set of criteria.

A "population" of plants, as used herein, can refer to a plurality of plants that were subjected to the same inoculation methods described herein, or a plurality of plants that are progeny of a plant or group of plants that were subjected to the inoculation methods. In addition, a population of plants can be a group of plants that are grown from coated seeds The plants within a population will typically be of the same species, and will also typically share a common genetic derivation.

As used herein, there is a "reduction" of one or more native microbes when a microbe, for example a microbe that inoculates a plant, partially or completely displaces of one or more species of native populations of endophytes. In other words, the inoculation with one microbe results in the reduction or loss of one or more native microbes in a plant or portion thereof. Consistent with the above, a "reduction of the non-endophytes" refers to a detectable reduction in one or more species of native non-endophyte microorganisms, when compared, for example, with a reference agricultural plant grown and/or treated with the same conditions.

As used herein, an "agriculturally acceptable" excipient or carrier is one that is suitable for use in agriculture without undue adverse side effects to the plants, the environment, or to humans or animals who consume the resulting agricultural products derived therefrom commensurate with a reasonable benefit/risk ratio.

As used herein, a microbe-associated plant or portion thereof is said to have an "altered chemical composition" when there is a detectable change in the chemical composition of such plant or portion thereof, when compared with a corresponding plant or portion thereof that is not associated with the microbe and grown and/or subjected to the same conditions.

In some embodiments, the present invention contemplates the use of a "community" of microbes. As used herein, a community of microbes refers to a plurality of distinct microbes. In some cases, the distinct microbes can be different species. In other cases, the community of microbes can be the same species but with distinct functions.

As used herein, a "productivity" of an agricultural plant refers to the production of the plant, or a desirable, or commercial portion thereof. Therefore, an increase in productivity of a plant, for example, can refer to an increase in fruit or grain yield. It can also refer to an overall increase in total biomass, or the portion that is harvested and used in commerce.

As used herein, a microbe is "viably incorporated" into a seed if it is located in the seed, and remains viable through desiccation.

Likewise, as used herein, a microbe is "stably incorporated" into a seed, if the microbe is capable of persisting in the plant after germination of the seed, and microbe or progeny of the microbe, is capable of colonizing the seeds from the plant.

A "microbial library" or "endophyte library" as used herein comprises a plurality of plant-associated microbes such as endophytes that can include bacteria and *fungi*. Libraries can, for example, be "bacterial endophyte libraries" or "fungal endophyte libraries" and comprise a diverse collection of entities. A microbial library may comprise 2, 3, 4, 5, 6, 7, 8, 9, 10, 15, 20, 50, 100, 1000, $1\times10^4$, $1\times10^5$, $1\times10^6$, $1\times10^7$, $1\times10^8$, $1\times10^9$, $1\times10^{10}$, $1\times10^{11}$, $1\times10^{12}$, or more microbial isolates. Isolates may be assessed by standard cultivation and characterization methods known on the art, including culturing of the library, single clone generation, nucleic acid (DNA/RNA) extraction and amplification (e.g. of 16S rRNA gene amplification) bacterial identification (through sequencing) and phylogenetic analyses. Microbial libraries may be generated and optionally maintained in any plant tissue or part of a plant, as desired, including whole bioreactor plants, progeny and seeds thereof. In some embodiments, microbial libraries are archived or stored in seed-based storage vessels comprising a seed and the microbes comprised in the library.

A "plurality" as used herein means "more than one of" e.g. a plant, a seed, a microbe, etc. and includes 2, 3, 4, 5, 6, 7, 8, 9, 10, 15, 20, 50, 100, 1000, $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, $1\times10^{15}$ or more of the given matter.

"Surface endophytes" as used herein are endophytes that are substantially located on the surface of, e.g., a seed or other part of a plant as opposed to within the interior, e.g. inside the seed coat or inside the seed. Such endophytes are substantially sensitive to surface sterilization as described herein.

"Archiving", e.g. of a microbial population means the preservation of a plurality of plant-associated microbes such as endophytes that can include bacteria and *fungi* and includes all forms of storing and storage units, such as, e.g. seed-based storage vessels. Archived microbes may be preserved or stored for a certain period of time, e.g. for at least 1 month, at least 3 months, or at least 6 months, for at least 12 months, for at least 2 years, or for at least 3 years. Archived microbes can be accessed from the storage unit at that later date, if desired, and optionally isolated, propagated, characterized or otherwise utilized. In some embodiments, the archived or stored microbes maintain their viability in that at least one of the archived microbes is capable of generating at least 1 CFU/storage unit if placed under suitable conditions in which microbial growth occurs. In other embodiments, the archived microbes are capable of generating at least 10, 100, 1000, $1\times10^4$, $1\times10^5$, $1\times10^6$, $1\times10^7$, $1\times10^8$ CFUs/storage unit. In some embodiment, the archived microbes, e.g. endophytes, display an enhanced stability relative to an unarchived microbe. "Enhanced stability" means that the archived or stored microbes display greater viability when compared to comparable microbes that are not archived or stored. For example, the archived or stored microbes are capable of generating a higher number of CFUs when placed under suitable conditions compared to unarchived microbes. In another example, the archived microbes are capable of generating at least 1 CFU/storage unit while the unarchived microbe does not generate a single colony after the same amount of storage under the same storage conditions. In some embodiments, enhanced stability means that archived microbes maintain viability under conditions that unarchived microbes would not, e.g. under conditions of high or low temperature, high or low humidity, irradiation (e.g. UV-light), pathogenic invasion, etc.

"Shelf-stable" as used herein means that a given archived or stored microbial composition or formulation displays stability (e.g. as measured by viability) of the comprised microbes under certain storage conditions. In some embodiments, the storage conditions do not require special accommodation, such as, e.g. tightly regulated cooling, heating, humidifying, or keeping of antiseptic conditions. In some embodiments, no accommodation is required and the shelf-stable formulations may be stored under any conditions, e.g. high and low temperatures, high and low humidity, atmospheric pressure, normal air, etc. Shelf-stable microbial formulations include seed-based vessels comprising microbes that retain their viability for at least 1 month, at least 3 months, or at least 6 months. In other embodiments, shelf-stable formulations include seed-based vessels comprising microbes that retain their viability for at least 12 months, for example for at least 2 years, or for at least 3 years.

An "anhydrous state" as used herein means a state, e.g. of a storage medium surrounding the microbes with low or no detectable amounts of water. A substantially anhydrous state includes states with less than about 30%, 20%, 10%, 9%, 8%, 7%, 6%, 5%, 4%, 3%, 2%, 1%, 0.1%, 0.01%, 0.001%, 0.0001% or less water w/w of the storage medium. In some embodiments, the storage medium is a seed-based storage vessel.

An "anaerobic state" as used herein means a state, e.g. of a storage medium surrounding the microbes with low or no detectable amounts of oxygen. A substantially anaerobic state includes states with less than about 15%, 10%, 9%, 8%, 7%, 6%, 5%, 4%, 3%, 2%, 1%, 0.1%, 0.01%, 0.001%, 0.0001% or less oxygen w/w of the storage medium. In some embodiments, the storage medium is a seed-based storage vessel.

An "abiotic stress" as used herein is an environmental stress condition that, e.g. a plant, a part of a plan, a seed or a microbe or population of microbes is subjected to that includes, e.g., drought stress, salt stress, heat stress, cold stress, and low nutrient stress. A "biotic stress" as used herein is an environmental stress condition that, e.g. a plant, a part of a plan, a seed or a microbe or population of microbes is subjected to that includes, e.g. nematode stress, insect herbivory stress, fungal pathogen stress, bacterial pathogen stress, or viral pathogen stress. The stress may be temporary, e.g. several hours, several days, several months, or permanent, e.g. for the life of the plant, seed of microbe.

The term "uniformity of the distribution", as used herein, is a measure of the uniformity of a population, for example, of seeds, with respect to the presence and/or quantity of microbes.

Therefore, a population in which 100% of the seeds in a population of seeds contains a microbe has a higher, or increased uniformity of seeds when compared with a population in which 70% of the seeds in a population contains the microbe. Likewise, a population in which 80% of the seeds in a population contains at least $10^2$ CFU of a microbe per seed has a higher, or increased uniformity of seeds when compared with a population in which 10%, 20%, 30%, 40%, 50% or greater than 50% of the seeds in a population contains at least $10^2$ CFU the microbe.

The term "uniformity of endophyte networks", as used herein, is a measure of the uniformity of a population of a plurality of microbe types in a plant or portion of a plant. A population of plants is considered to have an increased uniformity of endophyte networks than in a reference population when a higher proportion of plants in the population contain a representation of the same microbe types than in the reference population.

As used herein, the number of microbes of the same kind in a plant or a portion thereof is sometimes referred to as a "copy number". Therefore, a seed is considered to have a higher copy number of a first microbe than another microbe when the first microbe is present in higher numbers than the other microbe within the seed.

To date, the majority of microbial cultivation methods have relied upon in vitro methods comprising liquid-based, plate-based, solid-state, and other formats. In many such methods, bioreactors are utilized to create an environment within which desired microbes can be cultivated to encourage the scalable expansion of an initial inoculum. Methods for cultivating microbes within bioreactors can suffer from contamination of external microbes and can require the use of antibiotics or other undesirable agents. Further, cultivation of microbes in an artificial environment can select for variants of the microbe that alter or diminish its desired properties. For example, if the desired property of a microbe is not required for its efficient propagation in culture (e.g., production of a pharmaceutically, agriculturally, or industrially useful biomolecule), the microbe's physiology can shift or become altered so as to reduce its performance of that desired function. Such alterations can occur either transiently or as a result of genomic drift or loss of an important plasmid, thereby reducing the value of the resulting microbial population. Bioreactor-based methods have been successfully developed to allow the expansion of gram-negative microbes such as (e.g., *Escherichia coli*), gram-positive microbes (e.g., *Bacillus subtilis*), and multiple yeast and fungal hosts (e.g., *Aspergillus* and *Saccharomyces*). However, these taxa represent a very small subset of total microbial diversity and there is a strong need for novel methods to propagate as-yet uncultivated, difficult-to-cultivate, and other microbes to allow broader interrogation of their biology and their industrial use in biotechnology.

Genomic technologies and culture-independent microbial characterization methods illustrate that a significant amount of microbial biodiversity remains to be efficiently cultivated in lab or industrial settings. The GenBank® sequence database, which is an annotated collection of publicly-available nucleotide and amino acid sequences, contains sequences from over 30,000 species of bacteria. While this number may appear impressive, it is instructive to note that a recent estimate suggests that the ocean may support as many as 2 million different species of bacteria, and a ton of soil may support more than double that number (Curtis et al., Proc. Natl. Acad. Sd. USA 99:10494-10499, 2002). Furthermore, only about 13,000 of the bacteria represented in GenBank® have been formally described, and many of these lie within 4 of the 40 bacterial divisions (DeLong, Curr. Oγin. Microbiol. 4:290-295, 2001). The paucity of knowledge regarding other microbial species can be similar or greater. This is at least in part due to the fact a large diversity of microorganisms from the environment resist cultivation in the laboratory and an even greater diversity resists cultivation in methods that could be amenable to large-scale expansion of a desired microbial population or their storage in a shelf-stable format. Some estimates argue that such as-yet uncultivated or difficult-to-cultivate microbes may represent 99-99.99% of all microbial species in nature (see, e.g., Young, ASM News 63:417-421, 1997) and the majority of plant-associated microbes appear to fall in this category.

Microbial diversity is typically examined by amplifying 16S rRNA genes from DNA samples isolated from a specific habitat. The sequences are then compared to each other and to the 16S rRNA sequences from known species. If no close match to an existing 16S rRNA gene sequence is found, then the test sequence is thought to represent a new microorganism that is uncultivated or difficult to cultivate in lab settings. 16S rRNA genes, which are critical for translation, are the genes of choice for these experiments because they are thought to be conserved across vast taxonomic distance, yet show some sequence variation between closely related species. Phylogenetic analyses of 16S rRNA sequences obtained from direct sampling of environments suggest that uncultivated or difficult-to-cultivate microorganisms can be found in nearly every taxon within Bacteria and Archaea, and several groups at the division level have been identified without close cultivable representatives (see, e.g., Giovarmoni et al., Nature 345: 60-63, 1990; and Dojka et ah, Appl. Environ. Microbiol. 66:1617-1621, 2000).

A principal reason for this disparity is that a limited number of microorganisms from environmental samples grow on nutrient media in Petri dishes, liquid media, and other cultivation methods that have been utilized to date. The discrepancy between the microbial total count and plate count can be several orders of magnitude. Attempts to improve the recovery of microorganisms from environmental samples by manipulating growth media have improved the detectable fraction of cultivable microbes, but often such methods can come with the consequence of increased cost, complexity, and typically are restricted in their ability to allow large-scale expansion of desired microbes.

A number of methods have been explored to allow the cultivation of as-yet uncultivated or difficult-to-cultivate microbes within small bioreactor systems that can better mirror environmental and nutritional conditions of a microbe's habitat in nature. While such methods appear to increase the diversity of cultivatable microbes, they are often limited to volumes of a few milliliters or volumes of less than a liter and therefore are limited in the quantity of a desired microbe that can be produced at relatively low cost.

In a limited set of instances, living hosts have been utilized to propagate defined combinations of microbes. For example, sterile mammalian hosts have been introduced with microbes that propagate within the host gastrointestinal tract to allow propagation of difficult-to-cultivate microbes including segmented filamentous bacteria, fermicutes, bacteroides, and other microbes. These examples have included mammalian hosts that are inoculated with individual strains as well as hosts that are inoculated with a collection of multiple strains. The resulting hosts can harbor defined microbial communities and can be used to continually produce and excrete compositions that comprise the desired microbe. Such systems are desirable for their capacity to produce relatively large quantities of desired microbes at low costs.

Just as mammals serve as host to a complement of microbial symbionts across multiple epithelial habitats, plants serve as host to bacteria and *fungi* that live both within and around their tissues. Endophytes are fungal or bacterial organisms that live within plants. Bacterial endophytes, such as Firmicutes, Actinobacteria, Proteobacteria, Bacteroidetes, and Verrucomicrobia, appear to inhabit various host plant tissues, often colonizing intercellular spaces of host leaves, stems, flowers, fruits, or roots. Epiphytes are fungal or bacterial organisms that live on plants. The rhizosphere represents an additional habitat for bacterial and fungal microbes that reside in, on, or in close proximity to plant root tissues. A relatively small number of these plant-associated microbes have been cultivated in controlled laboratory settings and an even smaller number have been cultivated under conditions that are amenable to allowing large scale expansion of desired microbes. Thus, large fractions of plant-associated microbial diversity are as-yet-uncultivated or difficult-to-cultivate. Despite the limited number of such microbes that have been scalably cultivated or expanded, a diversity of potential industrial applications have been described for plant-associated microbes, including the production of medicinal bioactive molecules, including antibiotics, antimycotics, immunosuppressants, and anticancer agents. Such microbes may have applications across multiple industries including novel chemicals, pharmaceuticals, human or animal supplements, foods, agricultural products, and others. Thus, there is a significant need for novel methods to scalably cultivate plant-associated microbes in formats that allow the scalably expansion of a defined population of microbes.

There is an additional need for novel methods to create shelf-stable formulations of useful microbes. Frequently, the viability of microbes can be compromised when they are removed from their native habitat and subjected to the environmental conditions of laboratories, industrial settings, shipping facilities, and other environments in which microbes would desirably be stored. In various ways, harsh environmental conditions with fluctiontions in temperature, humidity, chemical exposure, mechanical stress, light and other electromagnetic radiation, and other stresses can adversely affect the viability of microbes. Often, fragile microbial preparations are stored in frozen conditions (sometimes even under conditions that utilize liquid nitrogen, −80 degree Celcius freezers, or other costly measures) using formulations that can include excipients such as glycerol, solutions that include low concentrations of solvents like dimethyl sulfoxide, preservatives, and others. In some cases, care is taken to dessicate a microbial preparation in an effort to improve its viability. Additional customized methods are used to tailor storage conditions to avoid specific stresses (e.g., anaerobic organisms are generally additionally stored under conditions that can help reduce exposure to oxygen, light-sensitive organisms are stored to avoid exposure to light, etc.). Each of these steps can add complexity and cost to a process and, even under such care, samples of desirable microbial preparations can become compromised, with viability diminishing over time or being lost entirely.

The present invention provides a surprisingly generalizable method for introducing defined microbial populations into plants such that the microbes replicate within plant reproductive tissues. The invention additionally provides methods for novel microbes to become packaged within plant seeds, which can then be stored under room-temperature conditions for extended periods of time. This method relies on a novel approach to co-opting the plant's ability to produce seeds in order to create seeds that serve as shelf-stabile vehicles of desired populations of novel microbes. In some embodiments these seeds are planted under indoor or outdoor conditions in order to allow scalable expansion of the desired microbial population.

Together, the present invention provides novel methods for propagating and storing plant-associated microbes. These methods involve the introduction of desired microbes to plant host 'bioreactors' in such a way that allows their growth in plant tissues and their reproducible entry into plant seeds as vehicles for their long-term shelf-stable storage. The invention particularly describes the use of plant hosts with agricultural precedent as a means of utilizing established agricultural practices as a means of allowing the uniform, scalable, and low-cost expansion of desired microbial preparations.

Aspects of the invention relate to methods of obtaining and cultivating plant-associated microbes. In some embodiments, the plant-associated microbes are symbionts. In some embodiments, the plant-associated microbes are endophytes. Plant-associated microbes include *fungi* and bacteria. In some embodiments, the microbes reside in or on the plant. In some embodiments, the microbes are propagated in the plant bioreactor, or a population of plant bioreactors, to obtain at least 10 times, at least 100 times, at least $10^3$ times, at least $10^4$ times, at least $10^5$ times, at least $10^6$ times, at least $10^7$ times, at least $10^8$ times, at least $10^9$ times as many microbes.

Aspects of the invention are based at least in part on the realization that plant-associated microbes have a number of agricultural utilities and present a valuable resource for obtaining a number of compounds of interest. The prior art provides many examples in which microbes are described as contaminants and a nuisance and numerous methods utilizing, e.g. antibiotics and fungicides have been described to eliminate microbes from plant cultures to avoid contaminations. Few methods are provided that allow the cultivation of plant-associated microbes. These methods generally utilize in vitro culture assemblies that require sterile conditions and tight controls on the environment, e.g. of temperature, humidity, oxygen content, media content, agitation, substrate, etc. These cultivation methods are expensive and difficult to maintain. Additionally, bacterial microbes and fungal microbes cannot generally be co-cultivated as they require different growth environments in artificial settings. Further, the cultivation methods are often not suitable for co-cultivation of certain groups of microbes, e.g. slow growing and fast growing microbes as they bias the culture that can be obtained to the microbe best adapted to the specific conditions provided in the in vitro culture assembly. These difficulties have led to the proposal that certain microbes are difficult to culture, or even unculturable. Because of the existing limitations many, if not most of the microbes existing in nature are as yet uncultured. The methods and plant bioreactors described herein can overcome the significant limitations of current in vitro microbial cultivation methods.

Any plant may be suitable for the co-cultivation of the selected microbes. Particularly suited plants are described herein include spermatophytes. Suitable plants that can be used as bioreactors to cultivate plant-associated microbes include both monocots and dicots (including eudicots) that can be colonized by the microbes according to the methods described herein. In some embodiments, the plant is a flowering plant (angiosperm). Suitable plants for use as a bioreactor to cultivate plant-associated microbes include, but are not limited to, grasses (Graminae), wheat, corn, rye grasses, and bluegrasses. Cultivars of maize, soybean, wheat, barley, and cotton are also suitable to cultivate plant-associated microbes according to the methods described herein. Further, genetically modified plants may be used as bioreactors to cultivate plant-associated microbes in accordance to the methods described herein.

In some aspects, methods are provided herein that allow the co-cultivation of selected microbes, e.g. endophytes. For example, two, three, four, five, six, seven, eight, nine, ten or more selected microbes may be co-cultivated. In some embodiments, the selected microbes may be co-cultivated in a plant bioreactor. For example, one or more microbes selected from those listed in Table 2 may be co-cultivated using the plant bioreactors and methods described herein. In some embodiments, a microbe of the family Microbacteriaceae can be co-cultured with a microbe of the family Chitinophagaceae. In some embodiments, a microbe of the family Microbacteriaceae can be co-cultured with a microbe of the family Bacillaceae. In some embodiments, a microbe of the family Microbacteriaceae can be co-cultured with a microbe of the family Planococcaceae. In some embodiments, a microbe of the family Microbacteriaceae can be co-cultured with a microbe of the family Clostridiaceae. In some embodiments, a microbe of the family Microbacteriaceae can be co-cultured with a microbe of the family Comamonadaceae. In some embodiments, a microbe of the family Microbacteriaceae can be co-cultured with a microbe of the family Oxalobacteraceae. In some embodiments, a microbe of the family Microbacteriaceae can be co-cultured with a microbe of the family Enterobacteriaceae. In some embodiments, a microbe of the family Microbacteriaceae can be co-cultured with a microbe of the family Pseudomonadaceae. In some embodiments, a microbe of the family Microbacteriaceae can be co-cultured with a microbe of the family Xanthomonadaceae.

In some embodiments, a microbe of the family Chitinophagaceae can be co-cultured with a microbe of the family Bacillaceae. In some embodiments, a microbe of the family Chitinophagaceae can be co-cultured with a microbe of the family Planococcaceae. In some embodiments, a microbe of the family Chitinophagaceae can be co-cultured with a microbe of the family Clostridiaceae. In some embodiments, a microbe of the family Chitinophagaceae can be co-cultured with a microbe of the family Comamonadaceae. In some embodiments, a microbe of the family Chitinophagaceae can be co-cultured with a microbe of the family Oxalobacteraceae. In some embodiments, a microbe of the family Chitinophagaceae can be co-cultured with a microbe of the family Enterobacteriaceae. In some embodiments, a microbe of the family Chitinophagaceae can be co-cultured with a microbe of the family Pseudomonadaceae. In some embodiments, a microbe of the family Chitinophagaceae can be co-cultured with a microbe of the family Xanthomonadaceae.

In some embodiments, a microbe of the family Bacillaceae can be co-cultured with a microbe of the family Planococcaceae. In some embodiments, a microbe of the family Bacillaceae can be co-cultured with a microbe of the family Bacillaceae can be co-cultured with a microbe of the family Clostridiaceae. In some embodiments, a microbe of the family Bacillaceae can be co-cultured with a microbe of the family Comamonadaceae. In some embodiments, a microbe of the family Bacillaceae can be co-cultured with a microbe of the family Oxalobacteraceae. In some embodiments, a microbe of the family Bacillaceae can be co-cultured with a microbe of the family Enterobacteriaceae. In some embodiments, a microbe of the family Bacillaceae can be co-cultured with a microbe of the family Pseudomonadaceae. In some embodiments, a microbe of the family Bacillaceae can be co-cultured with a microbe of the family Xanthomonadaceae.

In some embodiments, a microbe of the family Planococcaceae can be co-cultured with a microbe of the family Clostridiaceae. In some embodiments, a microbe of the family Planococcaceae can be co-cultured with a microbe of the family Comamonadaceae. In some embodiments, a microbe of the family Planococcaceae can be co-cultured with a microbe of the family Oxalobacteraceae. In some embodiments, a microbe of the family Planococcaceae can be co-cultured with a microbe of the family Enterobacteriaceae. In some embodiments, a microbe of the family Planococcaceae can be co-cultured with a microbe of the family Pseudomonadaceae. In some embodiments, a microbe of the family Planococcaceae can be co-cultured with a microbe of the family Xanthomonadaceae.

In some embodiments, a microbe of the family Clostridiaceae can be co-cultured with a microbe of the family Comamonadaceae. In some embodiments, a microbe of the family Clostridiaceae can be co-cultured with a microbe of the family Oxalobacteraceae. In some embodiments, a microbe of the family Clostridiaceae can be co-cultured with a microbe of the family Enterobacteriaceae. In some embodiments, a microbe of the family Clostridiaceae can be co-cultured with a microbe of the family Pseudomonadaceae. In some embodiments, a microbe of the family Clostridiaceae can be co-cultured with a microbe of the family Xanthomonadaceae.

In some embodiments, a microbe of the family Comamonadaceae can be co-cultured with a microbe of the family Oxalobacteraceae. In some embodiments, a microbe of the family Comamonadaceae can be co-cultured with a microbe of the family Enterobacteriaceae. In some embodiments, a microbe of the family Comamonadaceae can be co-cultured with a microbe of the family Pseudomonadaceae. In some embodiments, a microbe of the family Comamonadaceae can be co-cultured with a microbe of the family Xanthomonadaceae.

In some embodiments, a microbe of the family Oxalobacteraceae can be co-cultured with a microbe of the family Enterobacteriaceae. In some embodiments, a microbe of the family Oxalobacteraceae can be co-cultured with a microbe of the family Pseudomonadaceae. In some embodiments, a microbe of the family Oxalobacteraceae can be co-cultured with a microbe of the family Xanthomonadaceae. In some embodiments, a microbe of the family Enterobacteriaceae can be co-cultured with a microbe of the family Pseudomonadaceae. In some embodiments, a microbe of the family Enterobacteriaceae can be co-cultured with a microbe of the family Xanthomonadaceae. In some embodiments, a microbe of the family Pseudomonadaceae can be co-cultured with a microbe of the family Xanthomonadaceae.

In some embodiments, methods are provided allowing the co-cultivation of two or more (e.g., 3, 4, 5, 6, 7, 8, 9, 10, 15, 20, 25 or greater than 25) different microbes, such as endophytes, e.g., obtained from different families or different genera of microbes, such as bacteria, or from the same genera but different species of microbes. The different microbes can be obtained from the same cultivar of agricultural plant (e.g., the same maize, wheat, rice, or barley plant), different cultivars of the same agricultural plant (e.g., two or more cultivars of maize, two or more cultivars of wheat, two or more cultivars of rice, or two or more cultivars of barley), or different species of the same type of agricultural plant (e.g., two or more different species of maize, two or more different species of wheat, two or more different species of rice, or two or more different species of barley).

In some cases, the plant bioreactors are inoculated with microbes that are heterologous to the seed of the inoculated plant bioreactor. In one embodiment, the microbe is derived from a plant of another species. For example, a microbe that is normally found in dicots is applied to a monocot plant bioreactor (e.g., inoculating corn with a soy bean-derived endophyte), or vice versa. In other cases, the microbe to be inoculated onto a plant bioreactor is derived from a related species of the plant bioreactor that is being inoculated. In one embodiment, the microbe is derived from a related taxon, for example, from a related species. The plant of another species can be an agricultural plant.

The methods described herein are particularly suitable for co-cultivating multiple selected microbes. In some embodiments, using the plant bioreactors and methods described herein a desired ratio of selected microbes can be achieved. For example, under traditional in vitro culturing conditions fast-growing microbes may be able to outcompete slow growing microbes, making the latter difficult to culture, maintain or amplify. Nutrient-rich artificial media sources often encourage fast growing microbes, whereas nutrient-poor media sources encourage slow growing microbes. Acidification (pH), aerobic or anaerobic conditions, temperature, salt content, etc. can influence the growth rate of specific microbes and their ability to compete with co-cultivated microbes. As a result, many microbes are considered difficult to culture or even unculturable under current conditions. In some instances, microbes may be culturable singly but because of a lack of one or more competitive traits they are lost or their numbers substantially diminished when co-cultivated with other microbes. The plant bioreactors and co-cultivating methods described herein are particularly useful for the co-cultivation of microbes. Unlike artificial bioreactor setups, industrial or laboratory, that require machinery and complicated regulatory elements to control the environment, the plant bioreactors described herein are uniquely capable of providing a suitable environment for the co-cultivated microbes with little or no human intervention. Of course, if desired, the plant bioreactors may be subjected to changes in the environment, such as changes in the soil or water that can be applied to direct or influence the microbial composition comprised in the plant bioreactor.

For example, the plant bioreactors may be grown in different types of soil, such as gelisol, histosol, spodosol, andisol, oxisol, vertisol, aridisol, ultisol, mollisol, alfisol, inceptisol, entisol, acrisol, albeluvisol, alisol, andosol, anthrosol, arenosol, calcisol, cambisol, chernozem, cryosol, durisol, ferralsol, fluvisol, gleysol, gypsisol, histosol, kastanozem, leptosol, lixisol, luvisol, nitisol, phaeozem, planosol, plinthosol, podozol, regosol, solonchak, solonetz, and umbrisol, described further herein, to direct or influence the microbial composition comprised in the plant bioreactor. In another example, the plant bioreactors may be grown in soil types of different temperatures, such as pergelic soil (soils at temperatures from $-8°$ C. to $-4°$ C.), subgelic soil (soils at temperatures from $-4°$ C. to $0°$ C.), frigid soil (soils at temperatures from $0°$ C. to $8°$ C.), mesic soil (soils at temperatures from $8°$ C. to $15°$ C.), thermic soil (soils at temperatures from $15°$ C. to $22°$ C.), and pergelic soil (soils at temperatures from $22°$ C. or higher), described further herein, to direct or influence the microbial composition comprised in the plant bioreactor. In yet another example, the plant bioreactors may be grown in soil types of different degrees of moisture and/or degrees of oxygenation, such as aquic soil, udic soil, ustic soil, aridic soil, and xeric soil, described further herein, to direct or influence the microbial composition comprised in the plant bioreactor. In yet another example, the plant bioreactors may be grown in soil types of different soil pH, such as an ultra acidic soil (<3.5), an extreme acid soil (3.5-4.4), a very strong acid soil (4.5-5.0), a strong acid soil (5.1-5.5), a moderate acid soil (5.6-6.0), a slight acid soil (6.1-6.5), a neutral soil (6.6-7.3), a slightly alkaline soil (7.4-7.8), a moderately alkaline soil (7.9-8.4), a strongly alkaline soil (8.5-9.0), and a very strongly alkaline soil (>9.0), described further herein, to direct or influence the microbial composition comprised in the plant bioreactor. In yet another example, the plant bioreactors may be grown in soil types of varying degrees of (total) nitrogen, phosphorous, potassium, sulfur, calcium, magnesium, and sodium chloride, described further herein, to direct or influence the microbial composition comprised in the plant bioreactor.

Optionally, the plant bioreactor can be inoculated with additional microbes or the existing microbes may be supplemented at different times and in different frequencies, as desired, during the operation of the plant bioreactor (e.g. for the lifetime of the recipient plant before harvesting).

Suitable microbes for inoculation of the plant bioreactor include gram-positive bacteria, gram-negative bacterium and *fungi*. Any plant associated microbe may be used in the microbial cultivation methods described herein, including an endophyte, an epiphyte, or a rhizospheric microbe.

Suitable bacteria include *Burkholderia, Rhizobium, Mesorhizobium, Methylobacterium, Bacillus, Paenibacillus, Streptomyces, Enterobacter, Pseudomonas, Pantoea*, and others in Tables 1 and 2. Other suitable bacteria which may be used in the microbial cultivation methods described herein are listed in Tables A and B.

Suitable *fungi* include *Curvularia, Mycorrhiza, Pififmospora, Glomeromycota, Pififmospora, Fusrarium, Paecilomyces, Bionectria, Metarhizium, Trichoderma, Acremonium* and *Colletotrichum*. Other suitable *fungi* which may be used in the microbial cultivation methods described herein are listed in Tables D and E.

In some embodiments, the plant bioreactor comprises existing endogenous microbes. In some embodiments, the plant bioreactor is contacted with one or more additional microbes that are not endogenous to the plant. Optionally, one or more endogenous microbes are removed from the bioreactor.

For example, removal of endogenous microbes may include depletion, sterilization or reduction of carriage of an endogenous microbe. Chemical agents such as detergents such as, e.g., bleach (sodium hypochlorite), hydrogen peroxide, or ethanol may be used to remove endogenous microbes from the surface of the bioreactor plant. In order to remove some, substantially all, or all of the endogenous microbes, additional treatments are required. For example, in one embodiment, a plant or a part thereof (including a seed) can be treated with an antibacterial and/or antifungal agent that has sufficient permeability to enter the plant tissues and kill or hinder endogenous bacteria.

In some embodiments, the bioreactor plants are contacted with the one or more selected microbes. The selected microbes may be prepared for contacting by formulation of the microbes into a synthetic preparation, e.g. by any suitable method known in the art and those described herein. The contacting can be carried out by any suitable means and by the methods described herein.

For example, the preparation of microbes can be an aqueous solution, an oil-in-water emulsion or water-in-oil emulsion containing a minimum concentration of a microbe. Microbes may be present as live cells, viable cells, spores, or mycelia. Typically, the concentration may range from at least about $10^4$ CFU/ml to at least about $10^9$ CFU/mL, or more. The synthetic preparation may contain growth media or constituents required for the growth and propagation of the microbe, e.g. a growth medium selected from the group provided in Table F. The synthetic preparation can be of a defined pH range, typically from about pH 5.5 to about pH 7.5. The synthetic preparation can also comprise a carrier, such as diatomaceous earth, clay, or chitin, which act to complex with chemical agents, such as control agents. The synthetic preparation can also comprise an adherent, reagents that promote internalization of the microbes into the plant, a surfactant, an osmoticum, agents that promote stomatal opening, and other agents. In addition to aqueous suspensions, the microbial preparations of the invention can be applied in a dry formulation using, e.g., talc or some other particulate carrier. In such cases, the microbial preparation can be dried lyophilized in a manner preserving viability of the microbe (for example by using cryopreservants and/or protective sugars).

The bioreactor plants may be contacted with the one or more selected microbes, optionally provided as a synthetic preparation described herein by any suitable method, including, but not limited to, spraying on flowering plants, application to the flower by specific instruments, for example, by a spatula, a syringe or an inoculating loop, employing pollen-feeding insects or other pollinators. Additionally, the seeds or tubers can be submerged in the aqueous composition and then planted and allowed to grow into a plant. Furthermore, the soil around the plant or seed can be treated as well. When the plant to be treated is a tree, the composition can be introduced into the vascular system of the tree by conventional methods. In some embodiments, a suspension or paste of microbes is brushed or painted onto the whole plant or particular tissue/organs of the plant. In some embodiments, the entire bioreactor plant is contacted with the microbes, e.g. by spraying or submersion. In other embodiments, only one or more parts of the bioreactor plant are contacted, e.g. roots, shoots, leaves, above-ground tissues, or parts of the plant including the flowers or buds.

The bioreactor plants may be contacted with the microbes at any developmental stage of the plant, as desired. In some embodiments, the contacting step of the plant with the microbes is performed more than once at suitable intervals, as desired.

In one embodiment, the one or more microbes are placed onto a seed. In some embodiments, the one or more microbes are placed into a seed. In yet other embodiment, the one or more microbes are placed into and onto the seeds. In some embodiments, the one or more microbes are located on the seed coat or in the seed, as described further herein. Methods are provided herein that are useful for encapsulating one or more selected microbes within a seed. In some embodiments, the microbes are intercellularly located. In other embodiments, the microbes are intracellularly located. In some embodiments, the microbes are placed in or on the seed to generate plant bioreactors. In some embodiments, selected microbes are stored in seed-based vessels.

In some embodiments, microbial endophyte libraries are generated. Plant seeds may be contacted with an inoculum comprising a plurality of microbial endophytes and the resulting contacted seeds are collected. The microbial endophytes present in the contacted seed are subsequently incorporated into a bioreactor plant grown or derived from the contacted plant seed, such that a microbial endophyte library is generated within the bioreactor plant and/or the resulting seeds from the bioreactor plant. In some embodiments, the resulting contacted seed comprises one or more of the plurality of microbial endophytes of the inoculum. In some embodiments, the library generated in the seed comprises one or more endogenous microbial endophytes and optionally one or more of the plurality of microbial endophytes of the inoculum. In some embodiments, the contacted seed comprises endogenous and exogenous microbial endophytes. In some embodiments, at least on of the plurality of microbial endophytes of the inoculum is exogenous to the contacted seed.

In some embodiments, the microbes are amplified in the plant bioreactor. The amplification may suitably occur by planting and culturing the plant bioreactors in a field. For example, a field containing a population of plant bioreactors may range from at least about 100 square feet to at least about 50,000 or more. Other fields containing a population of plant bioreactors may range from at least about 1 acre to at least about 50,000 acres or more. Other fields containing a population of plant bioreactors may range from at least about 1 hectare to at least about 10,000 hectares or more. Some fields may comprise a population of plant bioreactors of 1 to 50 plants. Some fields may comprise a population of plant bioreactors ranging from at least about 50 plants to at least about 1,000,000 plants.

The plant bioreactors may be harvested and/or the selected microbes may be harvested. In certain embodiments, the selected microbes are located in or on a seed generated by the plant bioreactor. Optionally, the selected microbes may be stored for a period of time in a seed-based storage vessel. The seed-based storage vessels provide a shelf-stable format in which the microbes may be stored. Further provided herein are methods to generate shelf-stable formulations of microbes comprising generating seed-based storage vessels comprising microbes. For example, shelf-stable formulations include seed-based vessels comprising microbes that retain their viability for at least 1 month, at least 3 months, or at least 6 months. In other embodiments, shelf-stable formulations include seed-based vessels comprising microbes that retain their viability for at least 1 month, at least 2 months, at least 3 months, at least 6 months, 12 months, for example for at least 2 years, or for at least 3 years.

In certain embodiments, the seed-based storage vessels are selected for the long-term storage of selected microbes. For example, microbes may be stored in seed-based storage vessels that are resistant to an environmental stress. Environmental stresses include elevated or low temperatures, elevated or low humidity, and pathogen exposure. In vitro propagated and maintained microbes are particularly susceptible to changes in the environment, such as changes in temperature, humidity, pH, etc. and the cultures are susceptible to pathogenic invasion. In certain embodiments, seed-based storage vessels are provided that maintain the viability of the selected microbes for long period of time.

Optionally, the seed-based storage vessels may be further functionalized or modified to improve the storage conditions of the stored microbes and/or to prolong their viability in storage.

For example, the seed-based storage vessels may be coated with a coating composition as described herein. If desired, the coating composition may comprise a control agent, a plant growth regulator, and/or a fertilizer/nutrient. Suitable control agents for coating the seed-based storage vessels include, but are not limited to, antibacterial agents, fungicides, herbicides, insecticides, rodenticides, nematocides, miticides or bird repellents, a plant growth regulator and a fertilizer/nutrient.

If desired, the plant-associated microbes may be further isolated, e.g. isolated from the plant bioreactor or the seed-based storage vessel. The microbes may be isolated by any suitable method known in the art and those described herein, for example in Examples 7 to 14. Isolates may be cultivated by standard in vitro propagation methods. If desired the microbes can be assessed by standard cultivation and characterization methods known on the art, including culturing of the microbes, single clone generation, nucleic acid (DNA/RNA) extraction and amplification (e.g. of 16S rRNA gene amplification) microbial identification (e.g. through sequencing) and phylogenetic analyses. If desired, the isolated microbes may be used for the production of an inoculums as described herein, for example in Examples 7 to 14. Alternatively or in addition, the microbes may by maintained in culture, further isolated, modified (e.g. genetically modified), further characterized (e.g. screened for desired characteristic or capabilities), and/or combined to obtain desired microbial populations or communities. Isolated microbes may be stored in any suitable medium and may, e.g. be frozen.

Provided herein are further methods of amplifying plant microbes capable of producing a compound of interest using the plant bioreactors and methods described herein. A compound of interest includes a precursor or intermediate as well as a final compound. The bioreactor plants may be contacted with suitable microbes capable of producing the compound of interest and the microbes may be amplified using the methods described herein, including field application of the plant bioreactors. Optionally, the microbes may be isolated and stored, e.g. in seed-based storage vessels as described herein. Optionally, the compound of interest may be isolated from the microbes.

Provided herein are methods for propagating and isolating microbes that produce industrially-useful enzymes and chemicals. Current bioprocesses for producing industrial enzymes such as celluloses, peroxidases, proteases, and glycosidases or for producing biochemical from microbes typically involve monocultures of microbes in metallic bioreactors in a format that can require expensive synthetic media inputs, physical mixing systems, and methods for sensing key parameters for allowing microbial division and production (e.g., pH, osmolyte, and byproduct monitoring). Here, by discovering endophytes with the ability to produce such useful proteins and chemical products, the present invention provides the potential to produce such products or expand a population of microbes as useful inputs to such processes using low-cost plant propagation processes.

In characterizing the functional repertoire of microbes with the ability to be expanded within plant-based bioreactors, we identified endophytes with the ability to produce industrially-useful enzymes or industrially-useful chemicals. We discovered endophytes with the capacity to produce industrially useful enzymes such as cellulases, chitinases, and xylanases. Thus, in some embodiments, our invention utilizes plant-based bioreactors to provide for the production of a cellulose, a chitinase, or a xylanase within the tissues of an agricultural plant-based bioreactor. Thus, the invention allows the utilization of standard and novel agricultural methods for the scalable production of microbes with the capacity to produce such industrially-useful enzymes, and for the production of such enzymes within the plant tissues.

In some embodiments, our invention applies an isolated endophyte capable of producing an industrially-useful enzyme in a composition that allows it to colonize agricultural seeds, survive archiving on the surface or in the interior of the agricultural seed, and reproduce within agricultural plant-based bioreactors within at least one tissue such that it produces at least 1 CFU, at least 10, at least 100, at least 1,000, at least $10^4$, at least $10^5$, at least $10^6$, or at least $10^7$ CFU of the microbe capable of producing an industrially-useful enzyme per gram of the plant bioreactor tissue that the microbe replicates within. In some embodiments, the invention produces detectable quantities of the industrially-useful enzyme in at least one tissue of the plant, including the roots, shoots, leaves, flowers, and other tissues. In some embodiments, by utilizing standard or novel agricultural methods for planting the endophyte-contacted seeds, the invention allows the production of at least $10^4$, at least $10^5$, at least $10^6$, at least $10^7$, at least $10^8$, at least $10^9$, at least $10^{10}$, at least $10^{11}$, at least $10^{12}$, at least $10^{13}$, at least $10^{14}$, or at least $10^{15}$ CFU of the microbe capable of producing an industrially-useful enzyme per acre of seeds that are planted.

We also discovered endophytes capable of producing chemicals of industrial interest, including an auxin, antimicrobial compounds, siderophores, or acetoin. Thus, in some embodiments, our invention utilizes plant-based bioreactors to provide for the production of an auxin, antimicrobial compounds, siderophores, or acetoin within the tissues of an agricultural plant-based bioreactor. Thus, the invention allows the utilization of standard and novel agricultural methods for the scalable production of microbes with the capacity to produce such industrially-useful chemicals, and for the production of such chemicals within the plant tissues.

In some embodiments, our invention applies an isolated endophyte capable of producing an industrially-useful chemical in a composition that allows it to colonize agricultural seeds, survive archiving on the surface or in the interior of the agricultural seed, and reproduce within agricultural plant-based bioreactors within at least one tissue such that it produces at least 1 CFU, at least 10, at least 100, at least 1,000, at least $10^4$, at least $10^5$, at least $10^6$, or at least $10^7$ CFU of the microbe capable of producing an industrially-useful enzyme per gram of the plant bioreactor tissue that the microbe replicates within. In some embodiments, the invention produces detectable quantities of the industrially-useful enzyme in at least one tissue of the plant, including the roots, shoots, leaves, flowers, and other tissues. In some embodiments, by utilizing standard or novel agricultural methods for planting the endophyte-contacted seeds, the invention allows the production of at least $10^4$, at least $10^5$, at least $10^6$, at least $10^7$, at least $10^8$, at least $10^9$, at least $10^{10}$, at least $10^{11}$, at least $10^{12}$, at least $10^{13}$, at least $10^{14}$, or at least $10^{15}$ of the microbe capable of producing an industrially-useful chemical per acre of seeds that are planted.

Plants as Bioreactors and Agricultural Seeds as Vessels for Long-Term Microbial Storage Plants serve as 'bioreactors' for diverse microbes in nature and appear to, in some cases, be able to package a very small subset of such microbes into their seeds. Here, we sought to investigate whether plants could serve as novel bioreactors for exogenous microbes and, further, whether this could be accomplished in such a way that their seeds could comprise the novel microbe in a shelf-stable format such that these seeds could allow subsequent scale-up of the desired exogenous microbe via planting under standard agricultural conditions.

The prevailing view of plant endophytic communities is that they derive predominantly from the soil communities in which plants are grown [Hallman, J., et al., (1997) Canadian Journal of Microbiology. 43(10): 895-914]. Upon observing taxonomic overlap between the endophytic and soil microbiota in *A. thaliana* Dangl and colleagues stated, "Our rigorous definition of an endophytic compartment microbiome should facilitate controlled dissection of plant-microbe interactions derived from complex soil communities" [Lundberg et al., (2012) Nature. 488, 86-90]. Long et al., provide separate support for soil representing the repository from which plant endophytes are derived by writing, "Soil is considered as an endophyte bank . . . " [New Phytologist (2010) 185: 554-567]. Notable plant-microbe interactions such as mycorrhyzal *fungi* and bacterial rhizobia fit the paradigm of soil-based colonization of plant hosts and appear to primarily establish themselves independently of seed.

Less attention has been provided to the role of seeds as potential reservoirs for microbes that can efficiently populate the plant endosphere. The concept that seeds may harbor plant pathogens was promoted by Baker and Smith [(1966) Annu Rev Phytopathol 14: 311-334] and a few bacterial and fungal pathogens are known to be able to infect seed. When such pathogens are detected in a seed lot, it can necessitate destruction of vast numbers of agricultural germplasm [Gitaitis, R. and Walcott, R. (2007) Annu. Rev. Phytopathol. 45:371-97]. However, even when seed pathogens are detected, their transfer to the growing plant can be highly inefficient. For example, a study of seed-based transmission of the seed pathogen, *Pantoea stewartii*, found that seed produced from a population of pathogen-infected plants gave rise to infected seedlings in only 0.0029% of cases (1 of 34,924 plants) and artificially infected kernels only gave rise to infected seedlings in 0.022% of cases [Block, C. C., el al., (1998). Plant disease. 82(7). 775-780.]. Thus, the efficiency with which plants introduce pathogenic microbes into their seeds, and with which pathogens within seeds propagate within the resulting plant tissues can be very low.

The potential for agricultural seeds to serve as reservoirs for non-pathogenic microbes remains somewhat controversial [Hallman, J., et al., (1997) Canadian Journal of Microbiology. 43(10): 895-914]. Sato, et al., did not detect any bacteria inside rice seeds [(2003) In. Morishima, H. (ed.) The Natural History of Wild Rice—Evolution Ecology of Crop. p. 91-106] and Mundt and Hinkle only obtained endophytes from seed samples where seed coats had been broken or fractured in 29 kinds of plant seed [Appl Environ Microbiol. (1976) 32(5):694-8.]. Another group detected bacterial populations inside rice seeds ranging in population size from $10^2$ to $10^6$ CFU/g fresh weight [Okunishi, S., et al., (2005) Microbes and Environment. 20:168-177]. In crop cultivars such as maize, characterization of pooled seeds from within various cultivars from the genus *Zea* showed that endophytic *taxa* appear to be conserved across modern and ancestral variants [Johnston-Monje D, Raizada M N (2011) Conservation and Diversity of Seed Associated Endophytes in *Zea* across Boundaries of Evolution, Ethnography and Ecology. PLoS ONE 6(6): e20396. doi:10.1371/journal.pone.0020396]. This conservation of seed microbiota across large geographic, ecological, ethnic, and host genetic distances further implies that the seed microbiota is highly resilient to alteration and appears to resist the introduction of novel microbes or taxa, even after hundreds of generations of planting of host seeds into novel environments with diverse soil properties, microbial populations, and diverse agricultural chemistries and despite the use of transgenic methods to modify host plant genetic content. This finding is supported by characterization of individual maize seeds (the Raizada et al work characterized pools of ~15 maize seeds at a time) that observed limited overall taxonomic diversity within seeds and additionally described significant variability of the microbial communities within individual maize seeds, including substantial variability between seeds taken from the same cobb (Rosenblueth, M. et al, Seed Bacterial Endophytes: Common Genera, Seed-to-Seed Variability and Their Possible Role in Plants; Proc. XXVIIIth IHC—IS on Envtl., Edaphic & Gen. Factors; Affecting Plants, Seeds and Turfgrass; Eds.: G. E. Welbaum et al. Acta Hort. 938, ISHS 2012). These findings illustrate both that maize seeds appear to contain limited taxonomic diversity and that the microbiota of individual seeds produced by plants can be non-uniform, further implying that it would be challenging to uniformly introduce novel microbes into seeds produced by crops or for such microbes to be subsequently cultivated within the plant's tissue that results from the seed.

Surprisingly, we discovered a variety of methods for altering the microbiota of seeds produced by crops, including the ability to reliably add novel microbes into the seed microbiota, as a means of stably storing microbes in plant seeds and propagating them in plant-based bioreactors. Provided are methods for introducing novel microbes into plants or seeds such that the seeds produced by them are able to harbor novel microbes or an altered seed microbiota relative to reference seeds. Provided are methods for introducing novel microbes or substantially augmenting a microbial population in seeds. Additionally provided are methods for introducing populations of multiple symbionts to a seed or altering their abundance or spatial distribution relative to reference seeds. Methods for propagating the cultivars resulting from such seeds are provided such that the plants act as bioreactors for the cultivation of desired microbes. Provided are demonstrations that plant hosts with abundant precedence in agricultural practice can be utilized with the present methods, thereby allowing existing cultivation practices to be adapted to utilize the current methods and compostions.

The present invention offers advantages relative to the prior art practice of coating seeds with defined microbes or administering microbes to plant tissues. Notably, by generating seeds that natively harbor novel microbes or altered microbial populations, such seeds can be, in some cases, propagated repeatedly to allow scalable production of the resulting compositions using common agricultural practices. In some such embodiments, this compatibility with modern agricultural practices provides improved simplicity, reduced cost, and improved market adoption of the technology relative to current approaches of administering endophytes to plants for cultivation in a single generation. In some embodiments, seeds comprising novel microbes provide improved benefits to plants relative to a native seed that has been coated in a similar number of colony forming units of a novel microbe. In some embodiments, seeds comprising novel microbes that have been introduced by the present methods provide improved shelf-life relative to storage of the microbe on its own under similar conditions. In some embodiments, seeds with novel microbes provide improved compatibility with surface-coated chemistries (e.g., biocides, fungicides, antibiotics, etc) relative to a native seed that has been coated in a similar number of colony forming units of a novel microbe and the same surface chemistries. This compatibility with common agricultural chemistries can improve the use invention's ability to be practiced using established agricultural technologies.

Provided herein are methods of introducing microbes into the seed microbiota to create novel compositions comprising novel bacteria or *fungi* present in a monocot or dicot host seeds. Additionally provided are methods and compositions of seeds with altered microbiota, wherein the microbiota is substantially augmented, depleted, altered, or spatially redistributed in one or more strains relative to a reference seed population before alteration. As described herein, novel microbes are introduced into plant seeds by artificial inoculation, application, or other infection of a host plant, such as a plant, plant flower, or host plant tissues, with a bacterial or fungal strain of the present invention. These methods are optionally utilized in combination with methods to substantially alter or remove native symbionts within seeds or plant tissues, in order to prime them for administration of novel symbionts. These host plants are then utilized as a production process to generate seeds that have been pre-packaged with the novel microbial strain, such that the seeds can support the stable storage of the strain and the plants resulting from these seeds can support the scalable expansion of the microbe's population.

Microbe Located on and/or in the Seed

The present invention contemplates methods of introducing a microbe into the seed of a plant, as well as seed compositions comprising a microbe, wherein the microbe is located on and/or in the seed.

A seed is a small embryonic plant enclosed in a covering called the seed coat, usually with some stored food. It is the product of the ripened ovule of gymnosperm and angiosperm plants which occurs after fertilization and some growth within the mother plant. The formation of the seed completes the process of reproduction in seed plants (started with the development of flowers and pollination), with the embryo developed from the zygote and the seed coat from the integuments of the ovule.

A typical seed includes three basic parts: (1) an embryo, (2) a supply of nutrients for the embryo, and (3) a seed coat. The embryo is an immature plant from which a new plant will grow under proper conditions. The embryo has one cotyledon or seed leaf in monocotyledons, two cotyledons in almost all dicotyledons and two or more in gymnosperms. The radicle is the embryonic root. The plumule is the embryonic shoot. The embryonic stem above the point of attachment of the cotyledon(s) is the epicotyl. The embryonic stem below the point of attachment is the hypocotyl. Within the seed, there usually is a store of nutrients for the seedling that will grow from the embryo. The form of the stored nutrition varies depending on the kind of plant. In angiosperms, the stored food begins as a tissue called the endosperm, which is derived from the parent plant via double fertilization. The usually triploid endosperm is rich in oil or starch, and protein. In gymnosperms, such as conifers, the food storage tissue (also called endosperm) is part of the female gametophyte, a haploid tissue. In some species, the embryo is embedded in the endosperm or female gametophyte, which the seedling will use upon germination. In others, the endosperm is absorbed by the embryo as the latter grows within the developing seed, and the cotyledons of the embryo become filled with this stored food. At maturity, seeds of these species have no endosperm and are termed exalbuminous seeds. Some exalbuminous seeds are bean, pea, oak, walnut, squash, sunflower, and radish. Seeds with an endosperm at maturity are termed albuminous seeds. Most monocots (e.g. grasses and palms) and many dicots (e.g. Brazil nut and *Castor* bean) have albuminous seeds. All gymnosperm seeds are albuminous.

The seed coat (the testa) develops from the tissue, the integument, originally surrounding the ovule. The seed coat in the mature seed can be a paper-thin layer (e.g. peanut) or something more substantial (e.g. thick and hard in honey locust and coconut, or fleshy as in the sarcotesta of pomegranate). The seed coat helps protect the embryo from mechanical injury and from drying out. In addition to the three basic seed parts, some seeds have an appendage on the seed coat such an aril (as in yew and nutmeg) or an elaiosome (as in *Corydalis*) or hairs (as in cotton). A scar also may remain on the seed coat, called the hilum, where the seed was attached to the ovary wall by the funiculus.

There are several ways in which one can determine whether a microbe is located on and/or in the seed. The presence of the microbe can be determined microscopically, using reagents that can detect the microbe (e.g., antibodies that recognize the microbe, or a PCR-based detection system to detect presence of microbe-specific sequences within a seed sample). Alternatively, the location of the microbe within the seed can be determined by sterilizing the surface of the seed using any number of chemical agents (e.g., bleach, detergent, hydrogen peroxide or combinations thereof) to destroy any surface located microbes, and testing for the presence of surviving microbes after homogenizing the surface sterilized seeds under conditions allowing growth of the microbe. Therefore, the loss of microbe viability upon surface sterilization indicates that the microbes are almost exclusively located on the seed surface. In contrast, resistance of the microbe population to such seed sterilization methods indicates an internal localization of the microbes.

In one embodiment, the microbe is located on and/or in the seed. In another embodiment, the microbe is located on the seed coat or in the seed (i.e., located within the tissues/compartments contained within the seed coat). In still another embodiment, the microbe is located in the seed. In another embodiment, the microbe is located in the embryo of the seed. In another embodiment, the microbe is located within the endosperm of the seed. The presence of the microbe in the embryo or endosperm, as well as its localization with respect to the plant cells, can be determined using methods known in the art, including immunofluorescence microscopy using microbe specific antibodies, or fluorescence in situ hybridization (see, for example, Amann et al. (2001) Current Opinion in Biotechnology 12:231-236, incorporated herein by reference).

The methods described herein are useful for encapsulating a microbe within a seed. In one further embodiment, the microbe is intercellularly located. For example, at least 10% of the microbes in a seed, for example at least 20%, at least 30%, at least 40%, at least 50%, at least 60%, at least 70%, at least 80%, at least 90% or more of the microbe within the seed is intercellularly located. In another embodiment, at least 1 CFU of the microbe, for example, at least 10 CFU, at least 30 CFU, at least 100 CFU, at least 300 CFU, at least 1,000 CFU or more of the microbe is intercellularly located.

In another embodiment, the microbe is intracellularly located. For example, at least 10% of the microbes in a seed, for example at least 20%, at least 30%, at least 40%, at least 50%, at least 60%, at least 70%, at least 80%, at least 90% or more of the microbe within the seed is intracellularly located. In another embodiment, at least 1 CFU of the microbe, for example, at least 10 CFU, at least 30 CFU, at least 100 CFU, at least 300 CFU, at least 1,000 CFU or more of the microbe is intracellularly located.

Novel Plant and Agricultural Seed Compositions

The present invention provides surprisingly generalizable methods for introducing microbes into plant reproductive tissues such that they are able to be passaged into the interior or onto the surface of seeds. Therefore, in one aspect, the invention provides a novel seed comprising a microbe introduced on its surface or within its interior. The seeds described herein can comprise a unique microbial composition.

It is important to note that, none of the methods described in the prior art, particularly the methods disclosed in WO 00/29607 A1, WO 2011/117351 A1, WO 2010/115156 A2, WO 2007/107000 A1, WO 2007/021200 A1, US 2012/144533 A1, U.S. Pat. No. 4,940,834 A, CA 2562175 A1 and WO 2011/082455 A1 (each of which is incorporated by reference in its entirety), disclose methods for providing seeds comprising selected endophytes or novel microbes. The main goal of these prior art methods is the provision of the endophytes to the very plant treated and not—as is described herein—for producing a mother plant with the microbes of interest and to obtain microbe-containing seeds from this mother plant for rising daughter plants already containing the microbes and, optionally, passing the microbes further to their own daughter generation. As described herein, the microbe is viably and stably integrated into the seed. Accordingly, the technology provided with the present invention can provide seeds with completely novel characteristics, for example, having a unique microbial community (for example by having one single microbe species being predominantly present in the seeds or a plant that grows from such seeds (e.g., representing more than 1%, for example more than 10%, more than 20%, more than 30%, 50%, or more than 70% or even more than 80% of the total of microbes in the seed)).

In some cases, the present invention also provides seeds obtainable by the methods described herein, wherein the seed has unique characteristics, e.g., with a predominant microbe species as disclosed above. An embodiment of the present invention is therefore drawn to seeds obtainable by a method according to the present invention, wherein the microorganisms are present in a population density of 1 to $10^5$ CFU/seed.

The localization of the microbe within the seed can be determined by a number of methods. Its location with respect to the seed coat (i.e., whether the microbe is located on the surface of the seed or inside the seed coat, or inside the seed) can be determined rapidly by testing for its resistance to surface sterilization methods described elsewhere. The presence of microbial DNA after such surface sterilization, particularly using agents that cross-link or otherwise destroy DNA, using sensitive detection methods such as PCR, can be used to establish the presence of the microbe within the seed coat.

Viability of the microbe can be tested after seed surface sterilization, or after removal of the seed coat, by homogenizing the seed and growing the homogenate under conditions that promote growth of the microbe. In the alternative, the presence of microbes can be detected visually or microscopically if the microbes can form a colony that is visible by such inspection. Reagents are also available for the detection of microbes: the stain aniline blue can be used for detecting hyphae (Clark et al., J. Microbiol Methods (1983) 1: 149-155), other assays are known in the art (reviewed, for example, in Hiatt et al., (1999) Crop Science, 39: 796-799, WAG-conjugated fluorophore used by Lanver et al., (2010) Plant Cell 22: 2085-2101).

The methods described herein permit the alteration of the seed with novel or endogenous microbes. The advantage of these methods is that, when desired, the seed can be programmed with microbes that can localize to and propagate in distinct tissues or portions of the plant. As such, in one embodiment, inoculation with the microbes permits the localization of microbes into tissues, portions in which they are normally not associated.

In addition, in some cases, the microbe present in the seed is capable, upon germination of the seed into a vegetative state, of localizing to a different tissue of the plant. For example, the microbe can be capable of localizing to any one of the tissues in the plant, including: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem.

In yet another embodiment, the invention provides seed compositions comprising a microbe, in which the microbe is located on and/or inside the seed. In still another embodiment, the invention provides seed compositions in which the microbe is located predominantly on the surface the seed. In another embodiment, the microbe is located in the seed. For example, the microbe is located in the embryo of the seed. In another embodiment, the microbe is located in the endosperm of the seed.

In still another embodiment, the microbe is located intercellularly (i.e., between the cells of the plant). For example, at least 10% of the microbes in a seed, for example at least 20%, at least 30%, at least 40%, at least 50%, at least 60%, at least 70%, at least 80%, at least 90% or more of the microbe within the seed is intercellularly located. In another embodiment, at least 1 CFU of the microbe, for example, at least 10 CFU, at least 30 CFU, at least 100 CFU, at least 300 CFU, at least 1,000 CFU or more of the microbe is intercellularly located.

Alternatively, in another embodiment, the microbe is located intracellularly (i.e., within the plant cell). For example, at least 10% of the microbes in a seed, for example at least 20%, at least 30%, at least 40%, at least 50%, at least 60%, at least 70%, at least 80%, at least 90% or more of the microbe within the seed is intracellularly located. In another embodiment, at least 1 CFU of the microbe, for example, at least 10 CFU, at least 30 CFU, at least 100 CFU, at least 300 CFU, at least 1,000 CFU or more of the microbe is intracellularly located.

The presence of the microbe in the embryo or endosperm, as well as its localization with respect to the plant cells, can be determined using methods known in the art, including immunofluorescence microscopy using microbe specific antibodies, or fluorescence in situ hybridization (see, for example, Amann et al. (2001) Current Opinion in Biotechnology 12:231-236, incorporated herein by reference).

In another embodiment, the seed can contain a second microbe, which is also exogenous to the seed, and introduced into the seed using the methods described herein.

In another embodiment, microbes are present at a defined concentration within the seed. In one embodiment, each seed contains at least 1 CFU for example, 10 CFU for example, at least 100 CFU, at least 300 CFU, at least 1,000 CFU, at least 3,000 CFU or more, of the microbe.

In yet another embodiment, the microbe is present in the seed in a detectable level, and represents at least 0.1% of the total microbe population within the seed, for example at least, at least 0.5%, at least 1%, at least 2%, at least 3%, at least 4%, at least 5%, at least 10%, at least 20%, at least 30%, at least 40%, at least 50%, at least 60%, at least 70%, at least 80%, at least 90%, at least 95%, at least 99%, or 100% of the total microbe population in the seed. The presence and quantity of other microbes can be established by the FISH, immunofluorescence and PCR methods described above. Furthermore, homogenates of the seed can be plated onto various media, and the percentage of the total population represented by the microbe can be determined by counting the microbial colonies (e.g., number represented by the microbe vs. total microbe count).

In some cases, the microbes described herein are capable of moving from one tissue type to another in the inoculated plant bioreactor, e.g. from seed exterior into the vegetative tissues of a maturing plant. In one embodiment, a population of microbes, e.g., endophytes is capable of moving from the seed exterior into the vegetative tissues. In one embodiment, the seed microbe which is coated onto the seed of a bioreactor plant is capable, upon germination of the seed into a vegetative state, of localizing to a different tissue of the plant. For example, the microbe is capable of localizing to any one of the tissues in the plant, including: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In one embodiment, the microbe is capable of localizing to the root and/or the root hair of the plant. In another embodiment, the microbe is capable of localizing to the photosynthetic tissues, for example, leaves and shoots of the plant. In other cases, the microbe is localized to the vascular tissues of the plant, for example, in the xylem and phloem. In still another embodiment, the microbe is capable of localizing to the reproductive tissues (flower, pollen, pistil, ovaries, stamen, fruit) of the plant. In another embodiment, the microbe is capable of localizing to the root, shoots, leaves and reproductive tissues of the plant. In still another embodiment, the microbe colonizes a fruit or seed tissue of the plant. In still another embodiment, the microbe is able to colonize the plant such that it is present in the surface of the plant (i.e., its presence is detectably present on the plant exterior, or the episphere of the plant). In still other embodiments, the microbe is capable of localizing to substantially all, or all, tissues of the plant. In certain embodiments, the microbe is not localized to the root of a plant. In other cases, the microbe is not localized to the photosynthetic tissues of the plant.

In some cases, the microbes are capable of replicating within the plant bioreactor and colonizing it.

According to one embodiment, provided is a seed preparation containing seeds having more than 1%, for example more than 3%, more than 5%, more than 10%, more than 20%, more than 30%, for example more than 40%, or more than 50%, of the endophytic microorganisms are *Burkholderia phytofirmans*, especially *Burkholderia phytofirmans* PsJN (DSM17436); *Pantoea* sp. FD17 or *Paenibacillus* sp. S10., *Actinobacter* sp. S9, *Bradyrhizobium* sp. NC92 and *Bradyrhizobium japonicum* TAL379. In another embodiment, a maize seed produced by the methods described herein is provided wherein the microorganisms contained within the seed are *Burkholderia phytofirmans*, especially in a population density of 1 to $10^5$ cfu/g fresh weight of seed. It is known that in maize, usually the viable population densities are much lower (for sweet corn, it was reported that such concentrations are below $10^1$ cfu/g fresh weight (Kaga et al. Microbes Environ 24 (2009), 154-162)); in contrast thereto, the seeds according to this embodiment contain at least $10^2$, for example at least $10^3$, or at least $10^4$ CFU/g fresh weight of one species, especially of *Burkholderia phytofirmans* (strain PsJN). Accordingly, the microbe concentration of such seeds contains a predominant strain, which is not the case in natural plants or plants having been inoculated with prior art inoculation methods.

In some embodiments, the microbes contained within seeds obtained by the present method can be treated like normal seeds. The microbes remain safely packed inside the seed preventing the exposure of hazards from outside (which usually causes damage to cultures exposed to the environment). Accordingly, the seeds may be stored for considerable time without significant loss of their viability or properties. In one embodiment, the plant seed obtained by the present method containing microorganisms from the plant is stored for at least 1 month, for example at least 3 months, or at least 6 months.

Also much longer storage times are, of course, possible for the seeds produced according to the present invention. In another embodiment, the plant seed obtained by the present method containing microorganisms from the plant is stored for at least one month, at least 2 months, at least 3 months, at least 6 months, at least 12 months, for example for at least 2 years, or for at least 3 years.

The method according to the present invention is suitable for providing virtually any endophyte-containing seed, because the transfer of the microorganisms from the flower to the seed is a way with low hazard exposure (to plant and endophyte). It is specifically suitable for producing seeds with a microbe which is in principle known to naturally proliferate in plants, especially in the given plant, i.e., a "naturally obtainable endophyte". These endophytes are derivable from natural sources from the same plant type or from other plant types. According to one embodiment, the endophytic microorganism is therefore a naturally obtainable endophyte.

Novel Populations of Seeds

Also contemplated herein are populations of seeds. There is emerging evidence suggesting tremendous heterogeneity of the microbiome population within a single plant. For example, Rosenblueth et al. (2012) Acta Hort. (ISHS) 938: 39-48 documented seed-to-seed variability in bacterial endophyte populations even when the seeds are taken from the same cob. Further, when large numbers of seeds were analyzed together, Johnston-Monje and Raizada (2011) PLoS ONE 6(6): e20396, found that the observed microbes in *Zea* species were limited to a small number of taxa and highly conserved across ancient and modern varieties. Together, these results indicate (i) that seeds within a population can harbor heterogenous microbial populations and (ii) that even over hundreds of generations, the microbial taxa detected in *Zea* seeds is conserved, thereby implying that introducing novel symbionts to seeds in a single step or single generation is likely to be highly challenging. As such, a method that can consistently provide uniform microbial population (both qualitatively and quantitatively) within the shelf-stable vehicle of an agricultural seed, particularly where the microbe is capable of scalably propagating within the host plant, would be surprising and novel. The methods described herein contemplate the generation of seeds with highly uniform introduction of novel microbes. The benefit of producing uniform seeds in terms of its microbiome population is that the resulting plants are expected to more consistently propagate the desired microbes.

Therefore, in another aspect, the invention provides a substantially uniform population of isolated seeds. The uniformity of the microbes within the seed population can be measured in several different ways. In one embodiment, a substantial portion of the population of seeds, for example at least 10%, at least 20%, at least 30%, at least 40%, at least 50%, at least 60%, at least 70%, at least 75%, at least 80%, at least 90%, at least 95% or more of the seeds in a population, contains a viable microbe. In another embodiment, a substantial portion of the population of seeds, for example at least 10%, at least 20%, at least 30%, at least 40%, at least 50%, at least 60%, at least 70%, at least 75%, at least 80%, at least 90%, at least 95% or more of the seeds in a population contain a threshold number of viable microbe is at least 1 CFU per seed, at least 10 CFU per seed, for example, at least 100 CFU, at least 300 CFU, at least 1,000 CFU, at least 3,000 CFU or more, of the microbe per seed.

In some cases, a substantial portion of the population of seeds, for example, at least 10%, at least 20%, at least 30%, at least 40%, at least 50%, at least 60%, at least 70%, at least 75%, at least 80%, at least 90%, at least 95% or more of the seeds in a population, exhibits at least one of the endophyte community attributes listed in herein (e.g., total CFUs, presence of a novel taxa, absence of a common taxa, altered spatial distribution, intercellular colonization, industrially-useful properties of endophytes, presence of monoclonal strain, presence of conserved subset of microbial plasmid repertoire, microbe isolated from habitat that is distinct from the location of seed production, etc.).

In other cases, the genetic sequence of the microbe can be used to measure the genetic similarity of the virus within a population. In one embodiment, a substantial proportion of the seeds, for example, at least 10%, for example at least 20%, at least 30%, at least 40%, at least 50%, at least 60%, at least 70%, at least 80%, at least 90%, at least 95% or more of the seeds contain the same species or strain of microbe, for example, as determined by DNA sequence analysis. In one embodiment, a substantial proportion of the seeds, for example, at least 10%, for example at least 20%, at least 30%, at least 40%, at least 50%, at least 60%, at least 70%, at least 80%, at least 90%, at least 95% or more of the seeds contain the microbe of monoclonal origin, for example, as determined by DNA sequence analysis.

Increased uniformity of microbes in plants or seeds can also be detected by measuring the presence of non-genomic nucleic acids present in the microbes. For examples, where the microbe that is inoculated into the plant is known to harbor a plasmid or episome, the presence of the plasmid or episome can be detected in individual plants or seeds by using conventional methods of nucleic acid detection. Therefore, in one embodiment, a substantial portion of the population of seeds, for example at least example at least 10%, at least 20%, at least 30%, at least 40%, at least 50%, at least 60%, at least 70%, at least 75%, at least 80%, at least 90%, at least 95% or more of the seeds in a population, has a detectable presence of the microbial plasmid or episome.

Increased uniformity of the microbes' epigenetic status can also be used to detect increased uniformity. For example, where a microbe that has been inoculated by a plant is also present in the plant (for example, in a different tissue or portion of the plant), or where the introduced microbe is sufficiently similar to a microbe that is present in some of the plants (or portion of the plant, including seeds), it is still possible to distinguish between the inoculated microbe and the native microbe, for example, by distinguishing between the two microbe types on the basis of their epigenetic status. Therefore, in one embodiment, the epigenetic status is detected in microbes across individual seeds or the plants that grow from such seeds.

The methods described herein enable the creation of completely new seed/microbe combinations. One of the most significant properties of seeds obtainable by the present invention is the possibility to provide predominant endophyte populations in the seeds. Normally, seeds containing endophytes contain a diverse population of many different endophytic microorganisms with usually more than 10 or even more than 20 different identifiable culturable strains, the method according to the present invention enables, in some cases, the production of seeds with a predominant species of endophytic microorganism. Accordingly, in some embodiments, seed preparations which are provided by the present invention contain seeds having an endophytic microorganism population wherein more than 30%, for example more than 40%, or more than 50%, of the endophytic microorganisms represent the inoculant strain. This means that most (more than 50%, for example more than 60%, or more than 70%) of the seeds in the preparation contain more than 30%, for example more than 40%, or more than 50%, endophytic microorganisms comprising the inoculant strain.

In still another embodiment, in a substantial portion of the population of seeds, for example example at least 10%, at least 20%, at least 30%, at least 40%, at least 50%, at least 60%, at least 70%, at least 75%, at least 80%, at least 90%, at least 95% or more of the seeds in a population, the microbe represents at least 10%, least 20%, at least 30%, at least 40%, at least 50%, at least 60%, at least 70%, at least 80%, at least 90%, at least 95%, at least 99%, or 100% of the total microbe population in the seed.

Uniformity of the seed population can also be measured using other means. The uniformity can be measured, for example, on the basis of the absence or exclusion of a microbe (i.e., a microbe that was not inoculated according to the methods of the invention). As such, in one embodiment, the invention provides a population of seeds in which a substantial portion of the seeds, for example at least 10%, at least 20%, at least 30%, at least 40%, at least 50%, at least 60%, at least 70%, at least 75%, at least 80%, at least 90%, at least 95% or more of the seeds, do not contain a reference microbe, wherein the reference microbe may be an endogenous microbe (i.e., not exogenous to the seed).

It is also known that certain viruses are associated with endophytic *fungi* (such as the *Curvularia* thermal tolerance virus (CThTV) described in Marquez, L. M., et al., (2007). Science 315: 513-515). Therefore, the presence and quantity of a virus can be used to measure uniformity. For example, where the inoculated microbe is known to be associated with a virus, the presence of that virus can be used as a surrogate indicator of uniformity. Therefore, in one embodiment, a substantial portion of the seeds, for example at least 10%, at least 20%, at least 30%, at least 40%, at least 50%, at least 60%, at least 70%, at least 75%, at least 80%, at least 90%, at least 95% or more of the seeds, contain the virus. In other embodiments, where one or more of the endogenous microbes contain associated viruses which are not found in, and not compatible with the inoculated microbe, the loss (i.e., absence) of the virus can be used to measure uniformity of the seed population. As such, in another embodiment, a substantial portion of the seeds, for example example at least 10%, at least 20%, at least 30%, at least 40%, at least 50%, at least 60%, at least 70%, at least 75%, at least 80%, at least 90%, at least 95% or more of the seeds, do not contain the virus. In other cases, the genetic sequence of the virus can be used to measure the genetic similarity of the virus within a population. In one embodiment, a substantial proportion of the seeds, for example, at least 10%, for example at least 20%, at least 30%, at least 40%, at least 50%, at least 60%, at least 70%, at least 80%, at least 90%, at least 95% or more of the seeds contain the same virus, for example, as determined by sequence analysis.

In another aspect, the seeds according to the present invention provide a marketable seed product containing a predetermined weight or volume of seeds with a uniform endophyte composition. For example, a marketable seed product containing at least 100 g seeds, for example at least 1 kg seeds, at least 5 kg seeds, at least 10 kg seeds, can be provided by the method according to the present invention that contains—as a whole product—more than 1%, for example more than 5%, more than 10%, more than 20%, more than 30%, more than 40%, especially more than 50%, of a single species of an endophytic microorganism, i.e., the inoculant strain. According to a preferred embodiment, the present invention provides a marketable seed product containing at least 100 g seeds, for example, at least 1 kg seeds, for example at least 5 kg seeds, at least 10 kg seeds, wherein—as a whole product—more than 50%, for example, more than 60%, more than 70% of the microbial population is represented by a single species of an endophytic microorganism, i.e., the inoculant strain. According to another embodiment, the present invention provides a marketable seed product containing at least 100 g seeds, for example at least 1 kg seeds, at least 5 kg seeds, at least 10 kg seeds or more, wherein—as a whole product—more than 20%, more than 30%, more than 40%, more than 50%, more than 60%, more than 75%, more than 80%, more than 90%, or more, of the microbial population is represented by a single species (the microorganism of the inoculant strain) are contained.

Such uniformity in microbial composition is unique and is advantageous for high-tech and/or industrial agriculture. It allows significant standardization with respect to qualitative endophyte load of seed products. The term "marketable seed product" means any commercially usable product containing plant seeds in a suitable package (e.g., a box, a bag, an envelope or any other container used for storing, shipping or offering plant seeds for sale). Suitable volumes or weights are those that are currently used for plant seeds (e.g., the at least 100 g, at least 1, 5 or 10 kg; but also 25 or more, 40 or more, 50 kg or more, even 100 kg or more, 500 kg or more, 1 t or more, etc.). Suitable containers or packages are those traditionally used in plant seed commercialization: however, also other containers with more sophisticated storage capabilities (e.g., with microbiologically tight wrappings or with gas- or water-proof containments) can be used. The amount of endophytes (qualitatively and quantitatively) contained in the seeds or in the marketable seed product as a whole can be determined by standard techniques in microbiology readily available to any person skilled in the art of plant endophyte analysis.

In some cases, a sub-population of agricultural seeds can be further selected on the basis of increased uniformity, for example, on the basis of uniformity of microbial population. For example, individual seeds of pools collected from individual cobs, individual plants, individual plots (representing plants inoculated on the same day) or individual fields can be tested for uniformity of microbial density, and only those pools meeting specifications (e.g., at least 40%, 50%, 60%, 70%, or 80% of tested seeds have minimum density, as determined by quantitative methods described elsewhere) are combined to provide the agricultural seed sub-population.

The methods described herein can also comprise a validating step. The validating step can entail, for example, growing some seeds collected from the inoculated plants into mature agricultural plants, and testing those individual plants for uniformity. Such validating step can be performed on individual seeds collected from cobs, individual plants, individual plots (representing plants inoculated on the same day) or individual fields, and tested as described above to identify pools meeting the required specifications.

Microbes Useful for the Methods of the Invention

The present invention contemplates the use of different microbes to inoculate a plant. The microbe can be fungal in origin. Alternatively, the microbe can be bacterial in origin. In still other cases, the microbe can be a community of microbes.

The methods described herein are also useful for culturing microbes. This is particularly useful where the particular microbe is difficult to culture using traditional growth media. Therefore, in another aspect, disclosed herein are methods for growing a microbe, said method comprising the following steps. A preparation of inoculant microbes that is capable of growing and dividing in a plant is provided. A plant is then contacted with the preparation of microbes to produce an inoculated plant. The microbe-inoculated plant is then placed under conditions that permit the microbe to grow and divide in the inoculated plant.

In some cases, the microbe can be transmitted to and remain viable in the seed of the inoculated plant. The seed of the plant can provide an environment that allows the microbe to withstand the stresses of desiccation, temperature variation, and be preserved for extended periods of time. Therefore, in another embodiment, disclosed herein are methods of preserving the viability of a microbe by encapsulation within a seed of a plant, by obtaining the seed comprising the microbe from the plant, wherein the microbe is located inside the seed coat, and wherein the microbe remains viable within the seed. Where the microbe remains viable in the seed, the microbe may also be transmitted and propagated once the seed germinates and develops into a plant. Therefore, in still another embodiment, the microbe can be isolated from the progeny of the inoculated plant.

In some cases, the present invention contemplates the use of microbes that do not normally associate with the plants. For purposes of the invention, it is only necessary that the microbe be sufficiently compatible with the plant environment such that it is able to eventually be located on and/or in the seed of the plant.

The microbe can also be an organism that normally associates with plants, for example, as an endophyte, an epiphyte, a microbe associated with the surface of a plant or seed (an epispheric microbe), or a rhizospheric microbe, or a soil microbe. In one embodiment, the microbe is associated with the plant rhizosphere. In another embodiment, the microbe is normally associated with the surface of a plant or seed. In yet another embodiment, the microbe is an endophytic microbe.

In some cases, plants are inoculated with microbes that are exogenous to the seed of the inoculated plant. In one embodiment, the microbe is derived from a plant of another species. For example, a microbe that is normally found in dicots is applied to a monocot plant (e.g., inoculating corn with a soy bean-derived microbe), or vice versa. In other cases, the microbe to be inoculated onto a plant can be derived from a related species of the plant that is being inoculated. In one embodiment, the microbe can be derived from a related taxon, for example, from a related species. The plant of another species can be an agricultural plant. For example, a microbe derived from *Hordeum irregulare* can be used to inoculate a *Hordeum vulgare* L., plant. Alternatively, it can be derived from a 'wild' plant (i.e., a non-agricultural plant). For example, microbes normally associated with the wild cotton *Gossypium klotzschianum* can be used to inoculate commercial varieties of *Gossypium hirsutum* plants. As an alternative example of deriving an endophyte from a 'wild' plant, endophytic bacteria isolated from the South East Asian jungle orchid, *Cymbidium eburneum*, can be isolated and testing for their capacity to be cultured within agricultural crops such as wheat, maize, soy and others [Faria, D. C., et al., (2013) World Journal of Microbiology and Biotechnology. 29(2). pp. 217-221]. In other cases, the microbe can be isolated from an ancestral species of the inoculated plant. For example, a microbe derived from *Zea diploperennis* can be used to inoculate a commercial variety of modern corn, or *Zea mays*.

In some embodiments, two, three, four, five, six, seven, eight, nine, 10, or more microbes may be co-cultivated by the methods described herein. Suitable microbes for co-cultivation in bioreactor plants include families selected from the group consisting of Actinosynnemataceae, Dermabacteraceae, Geodermatophilaceae, Glycomycetaceae, Intrasporangiaceae, Kineosporiaceae, Microbacteriaceae, Micrococcaceae, Micromonosporaceae, Mycobacteriaceae, Nocardioidaceae, Promicromonosporaceae, Pseudonocardiaceae, Streptomycetaceae, Gaiellaceae, Chitinophagaceae, Cytophagaceae, Cryomorphaceae, Flavobacteriaceae, Sphingobacteriaceae, Parachlamydiaceae, A4b, Bacillaceae, Paenibacillaceae, Planococcaceae, Clostridiaceae, Caldicellulosiruptoraceae, Carboxydocellaceae, Caulobacteraceae, Methylobacteriaceae, Phyllobacteriaceae, Rhizobiaceae, Rhodospirillaceae, Erythrobacteraceae, Sphingomonadaceae, Alcaligenaceae, Burkholderiaceae, Comamonadaceae, Oxalobacteraceae, Methylophilaceae, Alteromonadaceae, Enterobacteriaceae, Coxiellaceae, Pasteurellaceae, Moraxellaceae, Pseudomonadaceae, Xanthomonadaceae, Leptospiraceae, Mycoplasmataceae, auto67-4W, Opitutaceae, and Verrucomicrobiaceae.

Suitable microbes for co-cultivation in bioreactor plants further include one or more, two, three, four, five, six, seven, eight, nine, or 10 families selected from the group consisting of Microbacteriaceae, Chitinophagaceae, Bacillaceae, Planococcaceae, Clostridiaceae, Comamonadaceae, Oxalobacteraceae, Enterobacteriaceae, Pseudomonadaceae, and Xanthomonadaceae.

Suitable microbes for co-cultivation in bioreactor plants further include one or more, two, three, four, five, six, seven, eight, nine, 10, or more of the generas selected from the group consisting of those genera in Table 1. Suitable microbes for co-cultivation in bioreactor plants further include one or more, two, three, four, five, six, seven, eight, nine, 10, or more of a non-*Bacillus* and/or a non-*Pseudomonas* genera and/or a non-*Rhizobium* genera.

In one embodiment, the microbe is an organism that is normally associated with the plant being inoculated. For example, the microbe can be a microorganism that is normally found in the rhizosphere of plants, on the surface of plants (i.e., an epiphyte), or found inside the plant (i.e., an endophyte). In one embodiment, the microbe is normally associated with the rhizosphere of the plant. In still another embodiment, the microbe is an epiphytic microbe (i.e., is associated with the surface of the plant). In yet another embodiment, the microbe can be an endophyte. Where the microbe is an organism that is normally associated with the plant, the method herein provides means of increasing the uniformity of distribution of the microbe in a population of plants or a portion thereof, including the seeds. For example, the method of inoculation results in seeds derived from inoculated plants, or plants derived from such seeds and progeny thereof, wherein the seed population is substantially uniform with respect to the microbial population across individual seeds derived from inoculated plants, or plants derived from such seeds and progeny thereof. Where the microbe is able to produce a beneficial product, the seed population can also be substantially uniform with respect to the beneficial product across individual seeds derived from inoculated plants, or plants derived from such seeds and progeny thereof. In one embodiment, the isolated microbe is present in the isolated agricultural seed, or any agricultural plant derived therefrom, at a higher level in a specific tissue than the isolated microbe is natively present in the specific tissue in an agricultural seed or any agricultural plant derived therefrom. In another embodiment, the isolated microbe is present in the isolated agricultural seed, or any agricultural plant derived therefrom, at a higher level than any other microbe present in the isolated agricultural seed or any agricultural plant derived therefrom.

Substantial uniformity can be measured using any of the means known in the art, or as described herein elsewhere.

In one embodiment, the microbe is an endophytic microbe that was isolated from a different plant than the inoculated plant. For example, in one embodiment, the microbe can be an endophyte isolated from a different plant of the same species as the inoculated plant. In some cases, the microbe can be isolated from a species related to the inoculated plant.

In another embodiment, the microbe is isolated from a different plant that is a stress-adapted plant. In some such embodiments, the plant is adapted to stresses of bacterial, fungal, insect, or other pathogenic stresses and its associated microbes have the capacity to produce bioactive molecules. In some such embodiments, the plant is adapted to stresses of heat, cold, salt, pH, drought, low nitrogen, low phosphate, flood, or other stresses and its associated microbes comprise the ability to produce stress-reducing molecules of agricultural or industrial importance.

In still other embodiments, the microbe can be an endophyte that normally resides in a tissue/organ other than the seed of the plant. For example, the microbe can be one that normally resides in the roots of a plant. Alternatively, the microbe can be one that normally resides in the leaves. In some cases, such localization may be exclusive (i.e., the microbe normally resides exclusively in the leaves of the plant).

It is to be understood that, upon inoculation and association with the plant, the microbe confers a detectable change to the plant when compared with a control plant that was not inoculated with the microbe. The detectable changes that can be conferred by the microbe either directly, or indirectly through its interactions with the host plant, are described herein elsewhere.

In some embodiments, the microbe useful for the present invention does not include any microbe which can alter the sequence of the host plant's chromosomal DNA, for example, by inserting a foreign nucleic acid. Therefore, in a particular embodiment, the microbe is not from the genus *Agrobacterium*. In a further embodiment, the microbe is not *Agrobacterium tumafaciens, Agrobacterium rhizogenes, Rhizobium* sp., *Rhizobium* sp. NGR234, *Rhizobium leguminosarum* Madison, *R. leguminosarum* USDA2370, *R. leguminosarum* bv. *trifolii* USDA2408, *R. leguminosarum* bv. *phaseoli* USDA2668, *R. leguminosarum* 2370G, *R. leguminosarum* 2370LBA, *R. leguminosarum* 2048G, *R. leguminosarum* 2048LBA, *R. leguminosarum* bv. *phaseoli, R.* leguminosarum bv. phaseoli 2668G, R. leguminosarum bv. phaseoli 2668LBA, R. leguminosarum RL542C, R. leguminosarum bv. viciae, R. leguminosarum bv. trifolii, Rhizobium etli USDA 9032, R. etli bv. phaseoli, Rhizobium tropici, Mesorhizobium sp., Mesorhizobium loti ML542G, M. loti ML4404, Sinorhizobium sp., Sinorhizobium meliloti SD630, S. meliloti USDA1002, Sinorhizobium fredii USDA205, S. fredii SF542G, S. fredii SF4404, S. fredii SM542C, Bradyrhizobium sp., Bradyrhizobium japonicum USDA 6, and B. japonicum USDA 110, Mesorhizobium loti, Sinorhizobium meliloti, Ochrobactrum sp. In some cases, it is possible, and in some cases likely, for the newly colonized microbe to make minor changes to the plant genome, resulting in changes to the epigenetic status (e.g., change in chromosomal methylation), or the introduction of minor sequence changes.

In some embodiments, the microbe useful for the present invention does not include at least one of Acetobacter sp., Acidovorax facilis, Azospirillum brasilense, Azospirillum lipoferum, Azospirillum sp., Azotobacter sp., Azotobacter vinelandii, Bacillus amyloliquefaciens FZB42, Bacillus amyloliquefaciens strain D747, Bacillus amyloliquefaciens TJ1000, Bacillus amyloliquefaciens TM45, Bacillus chitinosporus, Bacillus firmus, Bacillus firmus NCIM 2637, Bacillus firmus I-1582, Bacillus laterosporus, Bacillus licheniformis, Bacillus licheniformis, Bacillus marinus, Bacillus megaterium, Bacillus megaterium var. phosphaticum, Bacillus megatherium, Bacillus oleronius, Bacillus pumilus, Bacillus pumilus QST 2808, Bacillus sp., Bacillus subtilis, Bacillus subtilis FZB24, Bacillus subtilis MBI 600, Bacillus subtilis BSF4, Bacillus subtilis MBI600, Bacillus subtilis QST 713, Bacillus thuringensis var Kurstaki (NCIM 2514), Bacillus thuringiensis aizawai, Bacillus thuringiensis kurstaki, Bacillus thuringiensis kurstaki strain EG7841, Bacillus thuringiensis kurstaki strain SA-11, Bacillus thuringiensis subsp. kurstaki ABTS-351, Bacillus thuringiensis SV kurstaki EG 2348, Bacillus thuringiensis var Israelensis, Bacillus thuringiensis, Kurstaki variety, serotype 3A 3B, Bacillus thuringiensis, subsp. aizawai, Strain ABTS-1857, Bacillus thuringiensis, subsp. israelensis, strain AM 65-52, Chromobacterium subtsugae strain PRAA4-1, Delftia acidovorans, Frateuria aurantia, Lactobacillus casei, Lactobacillus delbrueckii, Lactobacillus fermentum, Lactobacillus helveticus, Lactobacillus plantarum, Lactococcus lactus, Methylobacterium mesophilicum, Methylobacterium organophilum, Methylobacterium extorquens, Paenibacillus polymyxa, Pasteuria spp., Pseudomonas spp., Pseudomonas fluorescens, Rhizobium sp., Rhodococcus rhodochrous, Rhodopseudomonas palustris, Streptomyces lydicus WYEC 108, Streptomyces ray, or Thiobacillus thiooxidans.

In some embodiments, the microbe useful for the present invention does not includeat least one of Acremonium butyri, Ampelomyces quisqualis, Ampelomyces quisqualis (DSM 2222), Ampelomyces quisqualis M-10, Arthrobotrys oligospora, Aspergillus oryzae, Beauvaria bassiana strain ATCC 74040, Beauveria bassiana, Beauveria bassiana (NCIM 1216 ATCC 26851), Beauveria bassiana strain GHA, Beauveria bassiana strain GHA 1991, Candida utilis, Chaetomium cupreum (CABI 353812), Chaetomium globosum, Clonostachys rosea 88-710, Fusarium oxysporum IF23, Fusarium proliferatum (NCIM 1101), Gliocladium, Gliocladium catenulatum strain J1446, Gliocladium virens GL-21, Glomus fasciculatum, Glomus intraradices, Hirsutella rhossiliensis, Isaria fumosorosea Apopka Strain 97, Metarhizium anisopliae, Metarhizium anisopliae (NCIM 1311), Metschnikowia fructicola, Myrothecium verrucaria, Neotyphodium lolii AR1, Neotyphodium lolii AR37, Neotyphodium lolii AR6, Neotyphodium lolii NEA2, Neotyphodium uncinatum, Paecilomyces fumorosoroseus strain FE 9901, Paecilomyces fumosoroseus, Paecilomyces lilacinus, Paecilomyces lilacinus (IIHR PL-2), Penicillium bilaii, Saccharomyces cerevisiae, Sclerotinia minor, Trichoderma asperellum TV1, Trichoderma asperellum strain ICC 012, Trichoderma gamsii strain ICC 080, Trichoderma harzianum, Trichoderma harzianum (IIHR-Th-2), Trichoderma harzianum Rifai strain T22, Trichoderma koningii, Trichoderma lignorum, Trichoderma polysporum, Trichoderma sp., Trichoderma virens G1-3, Trichoderma viride, Trichoderma viride (TNAU), Verticillium lecanii, or Verticillium lecanii (NCIM 1312).

Selection of Plant Species from Desired Habitats for Isolation of Microbial Endophytes Different environments can contain significantly different populations of microbes. For example, geographically isolated soils from different parts of the Americas have been shown to differ in 96% of the bacterial species they contain [Fulthorpe, R. R, et al., (2008) International Society for Microbial Ecology Journal. 2(9):901-910]. Soils containing different microbial populations can strongly influence the endophytic bacterial population observed inside Arabidopsis [Lundberg, D., et al., Nature (2012) 488, 86-90] illustrating that the environment can at least partially alter a plant's associated microbial population. This suggests that plants growing and especially thriving in choice environments are colonized by different and perhaps industrially-important microbes, whose scalable propagation could provide improved insights into the study of such microbes or the development of novel microbial isolates as biotechnologies. Additionally, novel symbionts may be found in related crop varieties grown in the choice environment. Identification of choice environments or ecosystems for bioprospecting of plant associated microbes from either wild plants or crop plants growing in the choice environments or ecosystems follows protocols described herein.

In one embodiment, the microbe-associated plant is harvested from a soil type different than the normal soil type that the crop plant is grown on, for example from a gelisol (soils with permafrost within 2 m of the surface), for example from a histosol (organic soil), for example from a spodosol (acid forest soils with a subsurface accumulation of metal-humus complexes), for example from an andisol (soils formed in volcanic ash), for example from a oxisol (intensely weathered soils of tropical and subtropical environments), for example from a vertisol (clayey soils with high shrink/swell capacity), for example from an aridisol (CaCO3-containing soils of arid environments with subsurface horizon development), for example from a ultisol (strongly leached soils with a subsurface zone of clay accumulation and <35% base saturation), for example from a mollisol (grassland soils with high base status), for example from an alfisol (moderately leached soils with a subsurface zone of clay accumulation and >35% base saturation), for example from a inceptisol (soils with weakly developed subsurface horizons), for example from a entisol (soils with little or no morphological development).

In a related embodiment, the microbe-associated plant is harvested from a soil type different than the normal soil type that the crop plant is grown on, for example from an acrisol, for example from an albeluvisol, for example from an alisol, for example from an andosol, for example from an anthrosol, for example from an arenosol, for example from a calcisol, for example from a cambisol, for example from a chernozem, for example from a cryosol, for example from a durisol, for example from a ferralsol, for example from a fluvisol, for example from a gleysol, for example from a gypsisol, for example from a histosol, for example from a kastanozem, for example from a leptosol, for example from a lixisol, for example from a luvisol, for example from a nitisol ample from a phaeozem, for example from a planosol, for example from a plinthosol, for example from a podozol, for example from a regosol, for example from a solonchak, for example from a solonetz, for example from an umbrisol, for example from a vertisol.

In another embodiment, the microbe-associated plant is harvested from an environment with average rainfall lower than the optimal average rainfall received by the crop plant, for example 2-5% less rainfall than average, for example, at least 5-10% less rainfall, at least 10-15% less rainfall, at least 15-20% less rainfall, at least 20-25% less rainfall, at least 25-30% less rainfall, at least 30-35% less rainfall, at least 35-40% less rainfall, at least 40-45% less rainfall, at least 45-50% less rainfall, at least 50-55% less rainfall, at least 55-60% less rainfall, at least 60-65% less rainfall, at least 65-70% less rainfall, at least 70-75% less rainfall, at least 80-85% less rainfall, at least 85-90% less rainfall, at least 90-95% less rainfall, or less, when compared with crop plants grown under normal conditions during an average growing season.

In one embodiment, the microbe-associated plant is harvested from an environment with average rainfall lower than the optimal average rainfall of the crop plant, for example 2-95% less rainfall than average, for example, at least 5-90% less rainfall, at least 10-85% less rainfall, at least 15-80% less rainfall, at least 20-75% less rainfall, at least 25-70% less rainfall, at least 30-65% less rainfall, at least 35-60% less rainfall, at least 40-55% less rainfall, at least 45-50% less rainfall, when compared with crop plants grown under normal conditions during an average growing season.

In one embodiment, the microbe-associated plant is harvested from an environment with average rainfall higher than the optimal average rainfall of the crop plant, for example 2-5% more rainfall than average, for example, at least 5-10% more rainfall, at least 10-15% more rainfall, at least 15-20% more rainfall, at least 20-25% more rainfall, at least 25-30% more rainfall, at least 30-35% more rainfall, at least 35-40% more rainfall, at least 40-45% more rainfall, at least 45-50% more rainfall, at least 50-55% more rainfall, at least 55-60% more rainfall, at least 60-65% more rainfall, at least 65-70% more rainfall, at least 70-75% more rainfall, at least 80-85% more rainfall, at least 85-90% more rainfall, at least 90-95% more rainfall, at least 95-100% more rainfall, or even greater than 100% more rainfall, or even greater than 200% more rainfall, or even greater than 300% more rainfall, or even greater than 400% more rainfall, or even greater than 500% more rainfall, when compared with crop plants grown under normal conditions during an average growing season.

In one embodiment, the microbe-associated plant is harvested from an environment with average rainfall higher than the optimal average rainfall of the crop plant, 2-500% more rainfall than average, 2-400% more rainfall than average, 2-300% more rainfall than average, 2-200% more rainfall than average, 2-95% more rainfall than average, for example, at least 5-90% more rainfall, at least 10-85% more rainfall, at least 15-80% more rainfall, at least 20-75% more rainfall, at least 25-70% more rainfall, at least 30-65% more rainfall, at least 35-60% more rainfall, at least 40-55% more rainfall, at least 45-50% more rainfall, when compared with crop plants grown under normal conditions during an average growing season.

In another embodiment, the microbe-associated plant is harvested from a soil type with different soil moisture classification than the normal soil type that the recipient crop plant is grown on, for example from an aquic soil (soil is saturated with water and virtually free of gaseous oxygen for sufficient periods of time, such that there is evidence of poor aeration), for example from an udic soil (soil moisture is sufficiently high year-round in most years to meet plant requirement), for example from an ustic soil (soil moisture is intermediate between udic and aridic regimes; generally, plant-available moisture during the growing season, but severe periods of drought may occur), for example from an aridic soil (soil is dry for at least half of the growing season and moist for less than 90 consecutive days), for example from a xeric soil (soil moisture regime is found in Mediterranean-type climates, with cool, moist winters and warm, dry summers).

In another embodiment, the microbe-associated plant is harvested from an environment with average rainfall lower than the optimal average rainfall received by the crop plant, for example 2-5% less rainfall than average, for example, at least 5-10% less rainfall, at least 10-15% less rainfall, at least 15-20% less rainfall, at least 20-25% less rainfall, at least 25-30% less rainfall, at least 30-35% less rainfall, at least 35-40% less rainfall, at least 40-45% less rainfall, at least 45-50% less rainfall, at least 50-55% less rainfall, at least 55-60% less rainfall, at least 60-65% less rainfall, at least 65-70% less rainfall, at least 70-75% less rainfall, at least 80-85% less rainfall, at least 85-90% less rainfall, at least 90-95% less rainfall, or less, when compared with crop plants grown under normal conditions during an average growing season.

In one embodiment, the microbe-associated plant is harvested from an environment with average rainfall lower than the optimal average rainfall of the crop plant, for example 2-95% less rainfall than average, for example, at least 5-90% less rainfall, at least 10-85% less rainfall, at least 15-80% less rainfall, at least 20-75% less rainfall, at least 25-70% less rainfall, at least 30-65% less rainfall, at least 35-60% less rainfall, at least 40-55% less rainfall, at least 45-50% less rainfall, when compared with crop plants grown under normal conditions during an average growing season.

In one embodiment, the microbe-associated plant is harvested from an environment with average rainfall higher than the optimal average rainfall of the crop plant, for example 2-5% more rainfall than average, for example, at least 5-10% more rainfall, at least 10-15% more rainfall, at least 15-20% more rainfall, at least 20-25% more rainfall, at least 25-30% more rainfall, at least 30-35% more rainfall, at least 35-40% more rainfall, at least 40-45% more rainfall, at least 45-50% more rainfall, at least 50-55% more rainfall, at least 55-60% more rainfall, at least 60-65% more rainfall, at least 65-70% more rainfall, at least 70-75% more rainfall, at least 80-85% more rainfall, at least 85-90% more rainfall, at least 90-95% more rainfall, at least 95-100% more rainfall, or even greater than 100% more rainfall, or even greater than 200% more rainfall, or even greater than 300% more rainfall, or even greater than 400% more rainfall, or even greater than 500% more rainfall, when compared with crop plants grown under normal conditions during an average growing season.

In one embodiment, the microbe-associated plant is harvested from an environment with average rainfall higher than the optimal average rainfall of the crop plant, 2-500% more rainfall than average, 2-400% more rainfall than average, 2-300% more rainfall than average, 2-200% more rainfall than average, 2-95% more rainfall than average, for example, at least 5-90% more rainfall, at least 10-85% more rainfall, at least 15-80% more rainfall, at least 20-75% more rainfall, at least 25-70% more rainfall, at least 30-65% more rainfall, at least 35-60% more rainfall, at least 40-55% more rainfall, at least 45-50% more rainfall, when compared with crop plants grown under normal conditions during an average growing season.

In another embodiment, the microbe-associated plant is harvested from a soil with an average pH range that is different from the optimal soil pH range of the crop plant, for example the plant may be harvested from an ultra acidic soil (<3.5), from an extreme acid soil (3.5-4.4), from a very strong acid soil (4.5-5.0), from a strong acid soil (5.1-5.5), from a moderate acid soil (5.6-6.0), from an slight acid soil (6.1-6.5), from an neutral soil (6.6-7.3), from an slightly alkaline soil (7.4-7.8), from an moderately alkaline soil (7.9-8.4), from a strongly alkaline soil (8.5-9.0), or from an very strongly alkaline soil (>9.0).

In another embodiment, the microbe-associated plant is harvested from an ecosystem where the agricultural plant is not normally found, for example a tundra ecosystem as opposed to a temperate agricultural farm, for example from tropical and subtropical moist broadleaf forests (tropical and subtropical, humid), for example from tropical and subtropical dry broadleaf forests (tropical and subtropical, semihumid), for example from tropical and subtropical coniferous forests (tropical and subtropical, semihumid), for example from temperate broadleaf and mixed forests (temperate, humid), for example from temperate coniferous forests (temperate, humid to semihumid), from for example from boreal forests/taiga (subarctic, humid), for example from tropical and subtropical grasslands, savannas, and shrublands (tropical and subtropical, semiarid), for example from temperate grasslands, savannas, and shrublands (temperate, semiarid), for example from flooded grasslands and savannas (temperate to tropical, fresh or brackish water inundated), for example from montane grasslands and shrublands (alpine or montane climate), for example from mediterranean forests, woodlands, and scrub or sclerophyll forests (temperate warm, semihumid to semiarid with winter rainfall), for example from mangrove forests, and for example from deserts and xeric shrublands (temperate to tropical, arid).

In another embodiment, the microbe-associated plant is harvested from an agricultural environment with a crop yield lower than the average crop yield expected from the crop plant grown under average cultivation practices on normal agricultural land, for example 2-5% lower yield than average, for example, at least 5-10% lower yield, at least 10-15% lower yield, at least 15-20% lower yield, at least 20-25% lower yield, at least 25-30% lower yield, at least 30-35% lower yield, at least 35-40% lower yield, at least 40-45% lower yield, at least 45-50% lower yield, at least 50-55% lower yield, at least 55-60% lower yield, at least 60-65% lower yield, at least 65-70% lower yield, at least 70-75% lower yield, at least 80-85% lower yield, at least 85-90% lower yield, at least 90-95% lower yield, or less, when compared with crop plants grown under normal conditions during an average growing season.

In a related embodiment, the microbe-associated plant is harvested from an agricultural environment with a crop yield lower than the average crop yield expected from the crop plant grown under average cultivation practices on normal agricultural land, for example 2-95% lower yield than average, for example, at least 5-90% lower yield, at least 10-85% lower yield, at least 15-80% lower yield, at least 20-75% lower yield, at least 25-70% lower yield, at least 30-65% lower yield, at least 35-60% lower yield, at least 40-55% lower yield, at least 45-50% lower yield, when compared with crop plants grown under normal conditions during an average growing season.

In one embodiment, the microbe-associated plant is harvested from an environment with average crop yield higher than the optimal average crop yield of the crop plant, for example 2-5% more yield than average, for example, at least 5-10% more yield, at least 10-15% more yield, at least 15-20% more yield, at least 20-25% more yield, at least 25-30% more yield, at least 30-35% more yield, at least 35-40% more yield, at least 40-45% more yield, at least 45-50% more yield, at least 50-55% more yield, at least 55-60% more yield, at least 60-65% more yield, at least 65-70% more yield, at least 70-75% more yield, at least 80-85% more yield, at least 85-90% more yield, at least 90-95% more yield, at least 95-100% more yield, or even greater than 100% more yield, or even greater than 200% more yield, or even greater than 300% more yield, or even greater than 400% more yield, or even greater than 500% more yield, when compared with crop plants grown under normal conditions during an average growing season.

In a related embodiment, the microbe-associated plant is harvested from an environment with average crop yield higher than the optimal average crop yield of the crop plant, 2-500% more yield than average, 2-400% more yield than average, 2-300% more yield than average, 2-200% more yield than average, 2-95% more yield than average, for example, at least 5-90% more yield, at least 10-85% more yield, at least 15-80% more yield, at least 20-75% more yield, at least 25-70% more yield, at least 30-65% more yield, at least 35-60% more yield, at least 40-55% more yield, at least 45-50% more yield, when compared with crop plants grown under normal conditions during an average growing season.

In another embodiment, the microbe-associated plant is harvested from a environment where soil contains lower total nitrogen than the optimum levels recommended in order to achieve average crop yields for a plant grown under average cultivation practices on normal agricultural land, for example 2-5% less nitrogen than average, for example, at least 5-10% less nitrogen, at least 10-15% less nitrogen, at least 15-20% less nitrogen, at least 20-25% less nitrogen, at least 25-30% less nitrogen, at least 30-35% less nitrogen, at least 35-40% less nitrogen, at least 40-45% less nitrogen, at least 45-50% less nitrogen, at least 50-55% less nitrogen, at least 55-60% less nitrogen, at least 60-65% less nitrogen, at least 65-70% less nitrogen, at least 70-75% less nitrogen, at least 80-85% less nitrogen, at least 85-90% less nitrogen, at least 90-95% less nitrogen, or less, when compared with crop plants grown under normal conditions during an average growing season.

In a related embodiment, the microbe-associated plant is harvested from a environment where soil contains lower total nitrogen than the optimum levels recommended in order to achieve average crop yields for a plant grown under average cultivation practices on normal agricultural land, for example 2-95% less nitrogen than average, for example, at least 5-90% less nitrogen, at least 10-85% less nitrogen, at least 15-80% less nitrogen, at least 20-75% less nitrogen, at least 25-70% less nitrogen, at least 30-65% less nitrogen, at least 35-60% less nitrogen, at least 40-55% less nitrogen, at least 45-50% less nitrogen, when compared with crop plants grown under normal conditions during an average growing season.

In another embodiment, the microbe-associated plant is harvested from a environment where soil contains higher total nitrogen than the optimum levels recommended in order to achieve average crop yields for a plant grown under average cultivation practices on normal agricultural land, for example 2-5% more nitrogen than average, for example, at least 5-10% more nitrogen, at least 10-15% more nitrogen, at least 15-20% more nitrogen, at least 20-25% more nitrogen, at least 25-30% more nitrogen, at least 30-35% more nitrogen, at least 35-40% more nitrogen, at least 40-45% more nitrogen, at least 45-50% more nitrogen, at least 50-55% more nitrogen, at least 55-60% more nitrogen, at least 60-65% more nitrogen, at least 65-70% more nitrogen, at least 70-75% more nitrogen, at least 80-85% more nitrogen, at least 85-90% more nitrogen, at least 90-95% more nitrogen, at least 95-100% more nitrogen, or even greater than 100% more nitrogen, or even greater than 200% more nitrogen, or even greater than 300% more nitrogen, or even greater than 400% more nitrogen, or even greater than 500% more nitrogen, when compared with crop plants grown under normal conditions during an average growing season.

In a related embodiment, the microbe-associated plant is harvested from a environment where soil contains higher total nitrogen than the optimum levels recommended in order to achieve average crop yields for a plant grown under average cultivation practices on normal agricultural land, 2-500% more nitrogen than average, 2-400% more nitrogen than average, 2-300% more nitrogen than average, 2-200% more nitrogen than average, 2-95% more nitrogen than average, for example, at least 5-90% more nitrogen, at least 10-85% more nitrogen, at least 15-80% more nitrogen, at least 20-75% more nitrogen, at least 25-70% more nitrogen, at least 30-65% more nitrogen, at least 35-60% more nitrogen, at least 40-55% more nitrogen, at least 45-50% more nitrogen, when compared with crop plants grown under normal conditions during an average growing season.

In another embodiment, the microbe-associated plant is harvested from a environment where soil contains lower total phosphorus than the optimum levels recommended in order to achieve average crop yields for a plant grown under average cultivation practices on normal agricultural land, for example 2-5% less phosphorus than average, for example, at least 5-10% less phosphorus, at least 10-15% less phosphorus, at least 15-20% less phosphorus, at least 20-25% less phosphorus, at least 25-30% less phosphorus, at least 30-35% less phosphorus, at least 35-40% less phosphorus, at least 40-45% less phosphorus, at least 45-50% less phosphorus, at least 50-55% less phosphorus, at least 55-60% less phosphorus, at least 60-65% less phosphorus, at least 65-70% less phosphorus, at least 70-75% less phosphorus, at least 80-85% less phosphorus, at least 85-90% less phosphorus, at least 90-95% less phosphorus, or less, when compared with crop plants grown under normal conditions during an average growing season.

In a related embodiment, the microbe-associated plant is harvested from a environment where soil contains lower total phosphorus than the optimum levels recommended in order to achieve average crop yields for a plant grown under average cultivation practices on normal agricultural land, for example 2-95% less phosphorus than average, for example, at least 5-90% less phosphorus, at least 10-85% less phosphorus, at least 15-80% less phosphorus, at least 20-75% less phosphorus, at least 25-70% less phosphorus, at least 30-65% less phosphorus, at least 35-60% less phosphorus, at least 40-55% less phosphorus, at least 45-50% less phosphorus, when compared with crop plants grown under normal conditions during an average growing season.

In another embodiment, the microbe-associated plant is harvested from a environment where soil contains higher total phosphorus than the optimum levels recommended in order to achieve average crop yields for a plant grown under average cultivation practices on normal agricultural land, for example 2-5% more phosphorus than average, for example, at least 5-10% more phosphorus, at least 10-15% more phosphorus, at least 15-20% more phosphorus, at least 20-25% more phosphorus, at least 25-30% more phosphorus, at least 30-35% more phosphorus, at least 35-40% more phosphorus, at least 40-45% more phosphorus, at least 45-50% more phosphorus, at least 50-55% more phosphorus, at least 55-60% more phosphorus, at least 60-65% more phosphorus, at least 65-70% more phosphorus, at least 70-75% more phosphorus, at least 80-85% more phosphorus, at least 85-90% more phosphorus, at least 90-95% more phosphorus, at least 95-100% more phosphorus, or even greater than 100% more phosphorus, or even greater than 200% more phosphorus, or even greater than 300% more phosphorus, or even greater than 400% more phosphorus, or even greater than 500% more phosphorus, when compared with crop plants grown under normal conditions during an average growing season.

In a related embodiment, the microbe-associated plant is harvested from a environment where soil contains higher total phosphorus than the optimum levels recommended in order to achieve average crop yields for a plant grown under average cultivation practices on normal agricultural land, 2-500% more phosphorus than average, 2-400% more phosphorus than average, 2-300% more phosphorus than average, 2-200% more phosphorus than average, 2-95% more phosphorus than average, for example, at least 5-90% more phosphorus, at least 10-85% more phosphorus, at least 15-80% more phosphorus, at least 20-75% more phosphorus, at least 25-70% more phosphorus, at least 30-65% more phosphorus, at least 35-60% more phosphorus, at least 40-55% more phosphorus, at least 45-50% more phosphorus, when compared with crop plants grown under normal conditions during an average growing season.

In another embodiment, the microbe-associated plant is harvested from a environment where soil contains lower total potassium than the optimum levels recommended in order to achieve average crop yields for a plant grown under average cultivation practices on normal agricultural land, for example 2-5% less potassium than average, for example, at least 5-10% less potassium, at least 10-15% less potassium, at least 15-20% less potassium, at least 20-25% less potassium, at least 25-30% less potassium, at least 30-35% less potassium, at least 35-40% less potassium, at least 40-45% less potassium, at least 45-50% less potassium, at least 50-55% less potassium, at least 55-60% less potassium, at least 60-65% less potassium, at least 65-70% less potassium, at least 70-75% less potassium, at least 80-85% less potassium, at least 85-90% less potassium, at least 90-95% less potassium, or less, when compared with crop plants grown under normal conditions during an average growing season.

In a related embodiment, the microbe-associated plant is harvested from a environment where soil contains lower total potassium than the optimum levels recommended in order to achieve average crop yields for a plant grown under average cultivation practices on normal agricultural land, for example 2-95% less potassium than average, for example, at least 5-90% less potassium, at least 10-85% less potassium, at least 15-80% less potassium, at least 20-75% less potassium, at least 25-70% less potassium, at least 30-65% less potassium, at least 35-60% less potassium, at least 40-55% less potassium, at least 45-50% less potassium, when compared with crop plants grown under normal conditions during an average growing season.

In another embodiment, the microbe-associated plant is harvested from a environment where soil contains higher total potassium than the optimum levels recommended in order to achieve average crop yields for a plant grown under average cultivation practices on normal agricultural land, for example 2-5% more potassium than average, for example, at least 5-10% more potassium, at least 10-15% more potassium, at least 15-20% more potassium, at least 20-25% more potassium, at least 25-30% more potassium, at least 30-35% more potassium, at least 35-40% more potassium, at least 40-45% more potassium, at least 45-50% more potassium, at least 50-55% more potassium, at least 55-60% more potassium, at least 60-65% more potassium, at least 65-70% more potassium, at least 70-75% more potassium, at least 80-85% more potassium, at least 85-90% more potassium, at least 90-95% more potassium, at least 95-100% more potassium, or even greater than 100% more potassium, or even greater than 200% more potassium, or even greater than 300% more potassium, or even greater than 400% more potassium, or even greater than 500% more potassium, when compared with crop plants grown under normal conditions during an average growing season.

In a related embodiment, the microbe-associated plant is harvested from a environment where soil contains higher total potassium than the optimum levels recommended in order to achieve average crop yields for a plant grown under average cultivation practices on normal agricultural land, 2-500% more potassium than average, 2-400% more potassium than average, 2-300% more potassium than average, 2-200% more potassium than average, 2-95% more potassium than average, for example, at least 5-90% more potassium, at least 10-85% more potassium, at least 15-80% more potassium, at least 20-75% more potassium, at least 25-70% more potassium, at least 30-65% more potassium, at least 35-60% more potassium, at least 40-55% more potassium, at least 45-50% more potassium, when compared with crop plants grown under normal conditions during an average growing season.

In another embodiment, the microbe-associated plant is harvested from a environment where soil contains lower total sulfur than the optimum levels recommended in order to achieve average crop yields for a plant grown under average cultivation practices on normal agricultural land, for example 2-5% less sulfur than average, for example, at least 5-10% less sulfur, at least 10-15% less sulfur, at least 15-20% less sulfur, at least 20-25% less sulfur, at least 25-30% less sulfur, at least 30-35% less sulfur, at least 35-40% less sulfur, at least 40-45% less sulfur, at least 45-50% less sulfur, at least 50-55% less sulfur, at least 55-60% less sulfur, at least 60-65% less sulfur, at least 65-70% less sulfur, at least 70-75% less sulfur, at least 80-85% less sulfur, at least 85-90% less sulfur, at least 90-95% less sulfur, or less, when compared with crop plants grown under normal conditions during an average growing season.

In a related embodiment, the microbe-associated plant is harvested from a environment where soil contains lower total sulfur than the optimum levels recommended in order to achieve average crop yields for a plant grown under average cultivation practices on normal agricultural land, for example 2-95% less sulfur than average, for example, at least 5-90% less sulfur, at least 10-85% less sulfur, at least 15-80% less sulfur, at least 20-75% less sulfur, at least 25-70% less sulfur, at least 30-65% less sulfur, at least 35-60% less sulfur, at least 40-55% less sulfur, at least 45-50% less sulfur, when compared with crop plants grown under normal conditions during an average growing season.

In another embodiment, the microbe-associated plant is harvested from a environment where soil contains higher total sulfur than the optimum levels recommended in order to achieve average crop yields for a plant grown under average cultivation practices on normal agricultural land, for example 2-5% more sulfur than average, for example, at least 5-10% more sulfur, at least 10-15% more sulfur, at least 15-20% more sulfur, at least 20-25% more sulfur, at least 25-30% more sulfur, at least 30-35% more sulfur, at least 35-40% more sulfur, at least 40-45% more sulfur, at least 45-50% more sulfur, at least 50-55% more sulfur, at least 55-60% more sulfur, at least 60-65% more sulfur, at least 65-70% more sulfur, at least 70-75% more sulfur, at least 80-85% more sulfur, at least 85-90% more sulfur, at least 90-95% more sulfur, at least 95-100% more sulfur, or even greater than 100% more sulfur, or even greater than 200% more sulfur, or even greater than 300% more sulfur, or even greater than 400% more sulfur, or even greater than 500% more sulfur, when compared with crop plants grown under normal conditions during an average growing season.

In a related embodiment, the microbe-associated plant is harvested from a environment where soil contains higher total sulfur than the optimum levels recommended in order to achieve average crop yields for a plant grown under average cultivation practices on normal agricultural land, 2-500% more sulfur than average, 2-400% more sulfur than average, 2-300% more sulfur than average, 2-200% more sulfur than average, 2-95% more sulfur than average, for example, at least 5-90% more sulfur, at least 10-85% more sulfur, at least 15-80% more sulfur, at least 20-75% more sulfur, at least 25-70% more sulfur, at least 30-65% more sulfur, at least 35-60% more sulfur, at least 40-55% more sulfur, at least 45-50% more sulfur, when compared with crop plants grown under normal conditions during an average growing season.

In another embodiment, the microbe-associated plant is harvested from a environment where soil contains lower total calcium than the optimum levels recommended in order to achieve average crop yields for a plant grown under average cultivation practices on normal agricultural land, for example 2-5% less calcium than average, for example, at least 5-10% less calcium, at least 10-15% less calcium, at least 15-20% less calcium, at least 20-25% less calcium, at least 25-30% less calcium, at least 30-35% less calcium, at least 35-40% less calcium, at least 40-45% less calcium, at least 45-50% less calcium, at least 50-55% less calcium, at least 55-60% less calcium, at least 60-65% less calcium, at least 65-70% less calcium, at least 70-75% less calcium, at least 80-85% less calcium, at least 85-90% less calcium, at least 90-95% less calcium, or less, when compared with crop plants grown under normal conditions during an average growing season.

In a related embodiment, the microbe-associated plant is harvested from a environment where soil contains lower total calcium than the optimum levels recommended in order to achieve average crop yields for a plant grown under average cultivation practices on normal agricultural land, for example 2-95% less calcium than average, for example, at least 5-90% less calcium, at least 10-85% less calcium, at least 15-80% less calcium, at least 20-75% less calcium, at least 25-70% less calcium, at least 30-65% less calcium, at least 35-60% less calcium, at least 40-55% less calcium, at least 45-50% less calcium, when compared with crop plants grown under normal conditions during an average growing season.

In another embodiment, the microbe-associated plant is harvested from a environment where soil contains higher total calcium than the optimum levels recommended in order to achieve average crop yields for a plant grown under average cultivation practices on normal agricultural land, for example 2-5% more calcium than average, for example, at least 5-10% more calcium, at least 10-15% more calcium, at least 15-20% more calcium, at least 20-25% more calcium, at least 25-30% more calcium, at least 30-35% more calcium, at least 35-40% more calcium, at least 40-45% more calcium, at least 45-50% more calcium, at least 50-55% more calcium, at least 55-60% more calcium, at least 60-65% more calcium, at least 65-70% more calcium, at least 70-75% more calcium, at least 80-85% more calcium, at least 85-90% more calcium, at least 90-95% more calcium, at least 95-100% more calcium, or even greater than 100% more calcium, or even greater than 200% more calcium, or even greater than 300% more calcium, or even greater than 400% more calcium, or even greater than 500% more calcium, when compared with crop plants grown under normal conditions during an average growing season.

In a related embodiment, the microbe-associated plant is harvested from a environment where soil contains higher total calcium than the optimum levels recommended in order to achieve average crop yields for a plant grown under average cultivation practices on normal agricultural land, 2-500% more calcium than average, 2-400% more calcium than average, 2-300% more calcium than average, 2-200% more calcium than average, 2-95% more calcium than average, for example, at least 5-90% more calcium, at least 10-85% more calcium, at least 15-80% more calcium, at least 20-75% more calcium, at least 25-70% more calcium, at least 30-65% more calcium, at least 35-60% more calcium, at least 40-55% more calcium, at least 45-50% more calcium, when compared with crop plants grown under normal conditions during an average growing season.

In another embodiment, the microbe-associated plant is harvested from a environment where soil contains lower total magnesium than the optimum levels recommended in order to achieve average crop yields for a plant grown under average cultivation practices on normal agricultural land, for example 2-5% less magnesium than average, for example, at least 5-10% less magnesium, at least 10-15% less magnesium, at least 15-20% less magnesium, at least 20-25% less magnesium, at least 25-30% less magnesium, at least 30-35% less magnesium, at least 35-40% less magnesium, at least 40-45% less magnesium, at least 45-50% less magnesium, at least 50-55% less magnesium, at least 55-60% less magnesium, at least 60-65% less magnesium, at least 65-70% less magnesium, at least 70-75% less magnesium, at least 80-85% less magnesium, at least 85-90% less magnesium, at least 90-95% less magnesium, or less, when compared with crop plants grown under normal conditions during an average growing season.

In a related embodiment, the microbe-associated plant is harvested from a environment where soil contains lower total magnesium than the optimum levels recommended in order to achieve average crop yields for a plant grown under average cultivation practices on normal agricultural land, for example 2-95% less magnesium than average, for example, at least 5-90% less magnesium, at least 10-85% less magnesium, at least 15-80% less magnesium, at least 20-75% less magnesium, at least 25-70% less magnesium, at least 30-65% less magnesium, at least 35-60% less magnesium, at least 40-55% less magnesium, at least 45-50% less magnesium, when compared with crop plants grown under normal conditions during an average growing season.

In another embodiment, the microbe-associated plant is harvested from a environment where soil contains higher total sodium chloride (salt) than the optimum levels recommended in order to achieve average crop yields for a plant grown under average cultivation practices on normal agricultural land, for example 2-5% more salt than average, for example, at least 5-10% more salt, at least 10-15% more salt, at least 15-20% more salt, at least 20-25% more salt, at least 25-30% more salt, at least 30-35% more salt, at least 35-40% more salt, at least 40-45% more salt, at least 45-50% more salt, at least 50-55% more salt, at least 55-60% more salt, at least 60-65% more salt, at least 65-70% more salt, at least 70-75% more salt, at least 80-85% more salt, at least 85-90% more salt, at least 90-95% more salt, at least 95-100% more salt, or even greater than 100% more salt, or even greater than 200% more salt, or even greater than 300% more salt, or even greater than 400% more salt, or even greater than 500% more salt, when compared with crop plants grown under normal conditions during an average growing season.

In a related embodiment, the microbe-associated plant is harvested from a environment where soil contains higher total sodium chloride (salt) than the optimum levels recommended in order to achieve average crop yields for a plant grown under average cultivation practices on normal agricultural land, 2-500% more salt than average, 2-400% more salt than average, 2-300% more salt than average, 2-200% more salt than average, 2-95% more salt than average, for example, at least 5-90% more salt, at least 10-85% more salt, at least 15-80% more salt, at least 20-75% more salt, at least 25-70% more salt, at least 30-65% more salt, at least 35-60% more salt, at least 40-55% more salt, at least 45-50% more salt, when compared with crop plants grown under normal conditions during an average growing season.

Bacterial Microbes

In one embodiment, the microbe can be a bacterium. The bacterium can be any bacterium, so long as the bacterium can remain viably incorporated on and/or in the seed. In some cases, it can be a gram-positive bacterium. In other cases, it can be a gram-negative bacterium. The bacterium can be any bacterium selected from the genera listed in Table 1. In some embodiments, the bacterium can be any bacterium selected from the genera listed in Table A. According to one particular embodiment, the microorganism is an endophytic bacterium, selected from *Burkholderia, Rhizobium, Bradyrhizobium, Mesorhizobium, and Sinorhizobium, Herbaspirillum, Methylobacterium, Azospirillum, Acetobacter, Arthrobacter, Bacillus, Paenibacillus, Streptomyces, Enterobacter*, and *Pseudomonas, Pantoea* and *Enterobacter*, especially *Burkholderia phytofirmans*.

In another embodiment, the bacterium can be a bacterium that is associated with a plant, for example a bacterium that is normally an endophyte, an epiphyte, or a rhizospheric bacterium. In one embodiment, the bacterium is an endophytic bacterium. In another embodiment, the bacterium is an endophytic bacterium selected from the bacteria listed in Table B and Table C. Endophytic bacteria also include those bacteria having a 16S nucleic acid sequence selected from the group consisting of SEQ ID NOs: 1-160. In another embodiment, the bacterium is not an endophyte, for example, not among the bacteria listed in Table B and Table C, and not a bacterium having a 16S nucleic acid sequence selected from the group consisting of SEQ ID NOs: 1-160.

Fungal Microbes

In another embodiment, the microbe can be a fungus. According to some embodiments, the endophytic microorganism is an endophytic fungus selected from *Curvularia, Mycorrhiza, Pififmospora, Glomeromycota, Pififmospora, Fusrarium, Paecilomyces, Bionectria, Metarhizium, Tricho-*

*derma, Acremonium* and *Colletotrichum*. The microbe can be from any one of the genera selected from the genera listed in Table D.

In another embodiment, the fungus can be a fungus that is associated with a plant, for example a fungus that is normally an endophyte, an epiphyte, or a rhizospheric fungus. In one embodiment, the fungus is selected from the endophytic *fungi* listed in Table E. In still another embodiment, the fungus is not an endophyte, for example, not among the *fungi* listed in Table E. It is also possible to use the present method for providing seeds with artificially created or optimized microorganisms, e.g., recombinantly engineered bacteria or *fungi*; or strains which have been optimized by various culture techniques and/or selection rounds. Another embodiment of the present invention is therefore to use a recombinantly produced (i.e., genetically engineered) microorganism.

Preparation of Microbes and Formulations

It is recommendable to safeguard conditions which are favourable to the microorganisms used. The microorganisms are usually applied in suspension at a suitable concentration. The preparation of microbes can be an aqueous solution, an oil-in-water emulsion or water-in-oil emulsion containing a minimum concentration of a microbe. Microbes may be present as live cells, viable cells, spores, or mycelia. Typically, the concentration is at least $10^4$ CFU/ml, for example at least $3\times10^4$ CFU/mL, at least $10^5$ CFU/mL, at least $3\times10^5$ CFU/mL, at least $10^6$ CFU/mL, at least $3\times10^6$ CFU/mL, at least $10^7$, at least $3\times10^7$ CFU/mL, at least $10^8$ CFU/mL, $10^9$ CFU/mL or more. In one embodiment, the preparation is a solution containing a microbe at a concentration between about $10^5$ CFU/mL and about $10^9$ CFU/mL. In another embodiment, the preparation contains a microbe at a concentration between about $10^6$ CFU/mL and about $10^8$ CFU/mL.

The synthetic preparation can also contain any number of other components. In one embodiment, the synthetic preparation may contain growth media or constituents required for the growth and propagation of the microbe. Examples of growth media that can be employed include those listed, for example, in: Hurst, Christon J., et al. Manual of environmental microbiology. No. Ed. 3. ASM press, 2007; DIFCO laboratories (Detroit, Mich.). Difco™ & BBL™ Manual: Manual of Microbiological Culture Media, 2nd Ed. Difco laboratories, 2009; Jones, Kenneth L. Journal of bacteriology 57.2 (1949): 141; Liu, Dong, et al. Proceedings of the National Academy of Sciences 91.5 (1994): 1888-1892; and Atlas, Ronald M. Handbook of microbiological media. Vol. 1. CRC press, 2004, each of which is incorporated by reference in its entirety. In one embodiment, the growth medium is selected from the group provided in Table F.

The synthetic preparation can be of a defined pH range. In one embodiment, the pH of the preparation can be between pH 5.5-6.0, pH 5.75-6.25, pH 6.0-6.5, pH 6.25-6.75, pH 6.5-7.0, pH 6.75-7.25, and pH 7.0-7.5. The pH of the medium can be adjusted using any biologically compatible buffering agent.

The synthetic preparation described herein can be formulated using an agriculturally compatible carrier. The formulation useful for these embodiments generally typically include at least one member selected from the group consisting of a tackifier, a microbial stabilizer, a fungicide, an antibacterial agent, an herbicide, a nematicide, an insecticide, a plant growth regulator, a rodenticide, a desiccant, and a nutrient.

In some cases, the synthetic preparation is mixed with an agriculturally compatible carrier. The synthetic preparation can also comprise a carrier, such as diatomaceous earth, clay, or chitin, which act to complex with chemical agents, such as control agents. The carrier can be a solid carrier or liquid carrier, and in various forms including microspheres, powders, emulsions and the like. The carrier may be any one or more of a number of carriers that confer a variety of properties, such as increased stability, wettability, or dispersability. Wetting agents such as natural or synthetic surfactants, which can be nonionic or ionic surfactants, or a combination thereof can be included in a composition of the invention. Water-in-oil emulsions can also be used to formulate a composition that includes the purified bacterial population (see, for example, U.S. Pat. No. 7,485,451, which is incorporated herein by reference in its entirety). Suitable formulations that may be prepared include wettable powders, granules, gels, agar strips or pellets, thickeners, and the like, microencapsulated particles, and the like, liquids such as aqueous flowables, aqueous suspensions, water-in-oil emulsions, etc. The formulation may include grain or legume products, for example, ground grain or beans, broth or flour derived from grain or beans, starch, sugar, or oil.

In some embodiments, the agricultural carrier may be soil or a plant growth medium. Other agricultural carriers that may be used include water, fertilizers, plant-based oils, humectants, or combinations thereof. Alternatively, the agricultural carrier may be a solid, such as diatomaceous earth, loam, silica, alginate, clay, bentonite, vermiculite, seed cases, other plant and animal products, or combinations, including granules, pellets, or suspensions. Mixtures of any of the aforementioned ingredients are also contemplated as carriers, such as but not limited to, pesta (flour and kaolin clay), agar or flour-based pellets in loam, sand, or clay, etc. Formulations may include food sources for the cultured organisms, such as barley, rice, or other biological materials such as seed, plant parts, sugar cane bagasse, hulls or stalks from grain processing, ground plant material or wood from building site refuse, sawdust or small fibers from recycling of paper, fabric, or wood. Other suitable formulations will be known to those skilled in the art.

The synthetic preparation can also comprise an adherent. Such agents are useful for combining the microbes of the invention with carriers that can contain other compounds (e.g., control agents that are not biologic), to yield a coating composition. Such compositions help create coatings around the plant or seed to maintain contact between the microbe and other agents with the plant or plant part. In one embodiment, adherents are selected from the group consisting of: alginate, gums, starches, lecithins, formononetin, polyvinyl alcohol, alkali formononetinate, hesperetin, polyvinyl acetate, cephalins, Gum Arabic, Xantham Gum, Mineral Oil, Polyethylene Glycol (PEG), Polyvinyl pyrrolidone (PVP), Arabino-galactan, Methyl Cellulose, PEG 400, Chitosan, Polyacrylamide, Polyacrylate, Polyacrylonitrile, Glycerol, Triethylene glycol, Vinyl Acetate, Gellan Gum, Polystyrene, Polyvinyl, Carboxymethyl cellulose, Gum Ghatti, and polyoxyethylene-polyoxybutylene block copolymers. Other examples of adherent compositions that can be used in the synthetic preparation include those described in EP 0818135, CA 1229497, WO 2013090628, EP 0192342, WO 2008103422 and CA 1041788, each of which is incorporated by reference in its entirety.

The synthetic preparation can also contain one or more reagents that promote internalization of the microbe into the plant, and can include any one of the following classes of compounds: a surfactant, an abrasive, an agent promoting stomatal opening, an osmoticum, and a plant signaling molecule.

The preparation can also contain a surfactant. Non-limiting examples of surfactants include nitrogen-surfactant blends such as Prefer 28 (Cenex), Surf-N(US), Inhance (Brandt), P-28 (Wilfarm) and Patrol (Helena); esterified seed oils include Sun-It II (AmCy), MSO (UAP), Scoil (Agsco), Hasten (Wilfarm) and Mes-100 (Drexel); and organo-silicone surfactants include Silwet L77 (UAP), Silikin (Terra), Dyne-Amic (Helena), Kinetic (Helena), Sylgard 309 (Wilbur-Ellis) and Century (Precision). In one embodiment, the surfactant is present at a concentration of between 0.01% v/v to 10% v/v. In another embodiment, the surfactant is present at a concentration of between 0.1% v/v to 1% v/v.

In certain cases, the formulation includes a microbial stabilizer. Such an agent can include a desiccant. As used herein, a "desiccant" can include any compound or mixture of compounds that can be classified as a desiccant regardless of whether the compound or compounds are used in such concentrations that they in fact have a desiccating effect on the liquid inoculant. Examples of suitable desiccants include one or more of trehalose, sucrose, glycerol, and Methylene glycol. Other suitable desiccants include, but are not limited to, non reducing sugars and sugar alcohols (e.g., mannitol or sorbitol). The amount of desiccant introduced into the formulation can range from about 5% to about 50% by weight/volume, for example, between about 10% to about 40%, between about 15% and about 35%, or between about 20% and about 30%.

The synthetic preparation of a defined osmolality can also be used. In one embodiment, the synthetic preparation has an osmolality of less than about 100 mOsm, for example less than about 75 mOsm, less than about 50 mOsm, or less than about 25 mOsm. In another embodiment, the synthetic preparation has an osmolality of at least 250 mOsm, for example at least 300 mOsm, at least 400 mOsm, at least 500 mOsm, at least 600 mOsm, at least 700 mOsm, at least 800 mOsm, 900 mOsm or greater. The osmolality of the preparation can be adjusted by addition of an osmoticum: the osmoticum can be any commonly used osmoticum, and can selected from the group consisting of: mannitol, sorbitol, NaCl, KCl, $CaCl_2$, $MgSO_4$, sucrose, or any combination thereof.

In some cases, it is advantageous for the formulation to contain agents such as a fungicide, an antibacterial agent, an herbicide, a nematicide, an insecticide, a plant growth regulator, a rodenticide, or a nutrient.

Also contemplated herein is the use of an agent and/or condition that promotes stomatal opening, in order to facilitate entry of the microbe into the plant. Agents and conditions known to induce stomatal opening include light, particularly blue light and red light (Reviewed in, for example, Schroeder et al., Annu. Rev. Plant Physiol. Plant Mol. Biol. 2001. 52:627-58). In addition, compounds which promote stomatal opening, or inhibit stomatal closing, such as Cyclosporin A, linolenic acid, arachidonic acid, coronatine and cytochalasin D.

In the liquid form, for example, solutions or suspensions, the microbes can be mixed or suspended in water or in aqueous solutions. Suitable liquid diluents or carriers include water, aqueous solutions, petroleum distillates, or other liquid carriers.

Solid compositions can be prepared by dispersing the microbes in and on an appropriately divided solid carrier, such as peat, wheat, bran, vermiculite, clay, talc, bentonite, diatomaceous earth, fuller's earth, pasteurized soil, and the like. When such formulations are used as wettable powders, biologically compatible dispersing agents such as non-ionic, anionic, amphoteric, or cationic dispersing and emulsifying agents can be used.

The solid carriers used upon formulation include, for example, mineral carriers such as kaolin clay, pyrophyllite, bentonite, montmorillonite, diatomaceous earth, acid white soil, vermiculite, and pearlite, and inorganic salts such as ammonium sulfate, ammonium phosphate, ammonium nitrate, urea, ammonium chloride, and calcium carbonate. Also, organic fine powders such as wheat flour, wheat bran, and rice bran may be used. The liquid carriers include vegetable oils such as soybean oil and cottonseed oil, glycerol, ethylene glycol, polyethylene glycol, propylene glycol, polypropylene glycol, etc.

The microbe can be obtained from growth in culture, for example, using synthetic growth medium. In addition, the microbe can be cultured on solid media, for example on petri dishes, scraped off and suspended into the preparation. Microbes at different growth phases can be used. For example, microbes at lag phase, early-log phase, mid-log phase, late-log phase, stationary phase, early death phase, or death phase can be used.

For certain microbes that exist as mycelia or mycelia-like structures, pre-treatment of the microbes with enzymes (including, but not limited to, driselase, gluculase, cellulase, beta-glucanase, lysozyme, zymolyase) can be used to generate protoplasts in order to provide a suspension of microbes. After generation of protoplasts, the microbes can be allowed to partially regenerate the cell walls by leaving the protoplasts in a growth medium or solution with relatively high osmolarity for a short time (typically less than about 12 hours at room temperature) to prevent bursting of protoplasts.

In certain embodiments, a composition described herein may be in the form of a liquid, a slurry, a solid, or a powder (wettable powder or dry powder). In another embodiment, a composition may be in the form of a seed coating. Compositions in liquid, slurry, or powder (e.g., wettable powder) form may be suitable for coating seeds. When used to coat seeds, the composition may be applied to the seeds and allowed to dry. In embodiments wherein the composition is a powder (e.g., a wettable powder), a liquid, such as water, may need to be added to the powder before application to a seed.

In still another embodiment, the methods can include introducing into the soil an inoculum of one or more of the microbes described herein. Such methods can include introducing into the soil one or more of the compositions described herein. The inoculum(s) or compositions may be introduced into the soil according to methods known to those skilled in the art. Non-limiting examples include in-furrow introduction, spraying, coating seeds, foliar introduction, etc. In a particular embodiment, the introducing step comprises in-furrow introduction of the inoculum or compositions described herein.

In one embodiment, seeds may be treated with composition(s) described herein in several ways but preferably via spraying or dripping. Spray and drip treatment may be conducted by formulating compositions described herein and spraying or dripping the composition(s) onto a seed(s) via a continuous treating system (which is calibrated to apply treatment at a predefined rate in proportion to the continuous flow of seed), such as a drum-type of treater. Batch systems, in which a predetermined batch size of seed and composition(s) as described herein are delivered into a mixer, may also be employed. Systems and apparati for performing these processes are commercially available from numerous suppliers, e.g., Bayer CropScience (Gustafson).

In another embodiment, the treatment entails coating seeds. One such process involves coating the inside wall of a round container with the composition(s) described herein, adding seeds, then rotating the container to cause the seeds to contact the wall and the composition(s), a process known in the art as "container coating". Seeds can be coated by combinations of coating methods. Soaking typically entails using liquid forms of the compositions described. For example, seeds can be soaked for about 1 minute to about 24 hours (e.g., for at least 1 min, 5 min, 10 min, 20 min, 40 min, 80 min, 3 hr, 6 hr, 12 hr, 24 hr).

Contacting the Plant with the Preparation of Microbes

In general terms, provided herein are methods of producing an agricultural seed that contains a novel population of microbes. The seed generated according to the present invention contains the microbe on and/or in the seed, and is generated by the following steps. First, a preparation of an isolated microbe, which is exogenous to the seed of the plant, is provided. The microbial preparation is then contacted with the plant. The plants are then provided with conditions such that the plant generates an agricultural seed, and the agricultural seed, which contain the microbes on and/or in the seed, are collected. The microbes contained within the seed are viably incorporated on and/or in the seed.

The microorganisms are e.g., sprayed on the parent flowering plants, enter the plants and colonize the emerging seeds. The microorganisms may also be applied by specific instruments to the flower, for example, by a spatula, a syringe or an inoculating loop. Another embodiment for administering the microbes to the flower of a plant is performed by employing pollen-feeding insects, for example bumblebees, that carry the endophytic microorganisms. Such insects (besides humble-bees also honey-bees, butterflies, some wasp and fly species or other "pollinators" may be used) can even be provided from commercial sources and contacted with the endophytes before they are released to contact the flowering plants. The microorganisms can be provided at a body part of these insects that has the highest probability to contact the flower of the plant (e.g., the legs or the ventral part of the body).

In addition to aqueous suspensions, the microbial preparations of the invention can be applied in a dry formulation using talc or some other particulate carrier. In such cases, the microbial preparation can be dried lyophilized in a manner preserving viability of the microbe (for example by using cryopreservants and/or protective sugars), and be present at a level of from about at least $10^2$ CFU per gram of dry formulation, for example, at least $10^3$ CFU per gram, at least $10^4$ CFU per gram, at least $10^5$ CFU per gram, at least $10^6$ CFU per gram, at least $10^7$ CFU per gram, at least $10^8$ CFU per gram, or more. Such dry compositions can be applied by dusting, or coating a plant, a plant field, or seed. In use, plants or seeds are treated with the compositions described herein by simply contacting one or more portions of the plant or seed. Additionally, the seeds or tubers can be submerged in the aqueous composition and then planted and allowed to grow into a protected plant. Furthermore, the soil around the plant or seed can be treated as well. When the plant to be treated is a tree, the composition can be introduced into the vascular system of the tree by conventional methods.

Also contemplated herein are methods of inoculating a plant with a plurality of microbes. The method can be performed in a manner similar to those described above for single microbe inoculation. Multiple microbes can be prepared in a single preparation which is contacted with the plant. Alternatively, a plant can be contacted sequentially with a first preparation containing the first microbe, then a second preparation containing the second microbe. In some other cases, the plant may be contacted with a first preparation of first microbes. The seeds of the plant are then collected, and allowed to germinate. The resulting progeny is then inoculated with a second preparation of second microbes, or a preparation containing the multiple microbes (e.g., the first and second microbes). The seeds of the inoculated progeny are then collected and tested for the presence of multiple microbes on and/or in the seed.

Where multiple microbes are inoculated onto a single plant, any or all of the microbes may be capable of producing a desired biomolecule or product within the host plant. In some cases, all of the microbes are capable of propagating within the host plant. In some cases, all of the microbes are able to enter into the host seeds for storage.

As described herein, a plant is contacted with a preparation of microbes. The preparation of microbes can be applied to the plant using several different means. For example, the preparation can be sprayed to the entire plant, or part of the plant (e.g., roots, shoots, leaves, above-ground tissues, or parts of the plant including the flowers or buds). In one embodiment, the above-ground tissues of the plant are sprayed with the suspension. In another embodiment, the areas around the bud and flowers of a plant are sprayed with the microbial suspension. In still another embodiment, the meristem tissues and surrounding areas of a plant are sprayed with the microbial suspension.

A suspension or paste of microbes can be brushed or painted onto the whole plant or particular tissue/organs of the plant. In one embodiment, a suspension or paste of microbes is brushed onto any one of the tissues/organs and surrounding parts selected from the group consisting of the flower, bud, and meristematic tissue.

A plant can also be submerged into a preparation containing the microbes (e.g., a microbial suspension). For example, the entire plant, or part of the plant (e.g., roots, shoots, leaves, above-ground tissues, or parts of the plant including the flowers or buds) can be submerged into a microbial suspension for a defined period of time. In one embodiment, a plant or a portion thereof is submerged for a period of at least 5 minutes, for example at least 10 minutes, at least 15 minutes, at least 30 minutes, at least 1 hour, at least 2 hours, at least 5 hours or more. In another embodiment, the plant, or a portion thereof, is submerged in the microbial suspension for no longer than 48 hours, for example, no longer than 24 hours, no longer than 12 hours, or no longer than 6 hours.

As described herein, a plant can be contacted with the microbial preparation at defined developmental stages. For example, the microbial preparation can be contacted with the plant at any one of the stages selected from the group consisting of the imbibition, germination stage, emergence stage, vegetative stage, and reproductive stages. In one embodiment, the plant is contacted with the preparation of microbes at the stage selected from the post-imbibition, post-germination stage, post-emergence stage, vegetative stage, reproductive stage and post-reproductive stage. In one particular embodiment, the plant is contacted with the microbial preparation at the vegetative and reproductive stages. In still another embodiment, a post-germination, pre-reproductive plant (i.e., before the first flower is open) is contacted with the microbial preparation. In yet another embodiment, a plant at the inflorescence emergence stage and flowering stage are contacted with the microbial preparation.

In an alternative description, the plant is contacted with the microbial preparation at various stages defined by the BBCH scale (see, for example, Zadoks, J. C et al., (1974). Weed Research 14 (6): 415-421, which is incorporated herein in its entirety). While the scale differs by plant species, there are some general growth phases: 0: Germination; 1: Leaf development; 2: Tillering/Development of side shoots; 3: Stem elongation; 4: Booting; 5: Inflorescence emergence, heading; 6: Flowering, anthesis; 7: Development of fruit; 8: Ripening; 9: Senescence. Therefore, in one embodiment, a plant that is between growth phase 0 and growth phase 9 is contacted with the microbial preparation. In another embodiment, a plant that is between growth phase 1 and growth phase 8 is contacted with the microbial preparation. In still another embodiment, a plant that is between growth phase 2 and growth phase 7 is contacted with the microbial preparation. In a particular embodiment, a plant that is between growth phase 5 and growth phase 7 is contacted with the microbial preparation. In still another embodiment, a plant that is between growth phase 1 and growth phase 5 can be contacted with a microbial preparation. In a final embodiment, a plant that is in growth phases 0-5, 7-9 can be contacted with a microbial preparation.

In still another embodiment, a plant is contacted at a time between about 2 weeks prior to flowering and during flowering. In other words, plants at growth stage between 5 and 6 are contacted with the preparation of microbes.

In one embodiment, contacting the flower of a plant with a preparation of microorganisms is performed via spraying the microorganisms at the time of flowering. Spraying is specifically useful as an industrial production method and can be easily automated, e.g., in glasshouse cultures. Other methods include the inoculation by using a brush, or an inoculating loop, or by applying droplets, powders, gels, solids, or other materials containing the microbe.

In some cases, the plant is contacted with the preparation of microbes more than once. For example, the plant can be contacted with the preparation of microbes at least twice, for example, three times, four times, five times, six times, or more. Thus, in one embodiment, the plant that is between growth phase 0 and growth phase 9 is contacted with the microbial preparation more than once. In another embodiment, a plant that is between growth phase 1 and growth phase 8 is contacted more than once with the microbial preparation. In still another embodiment, a plant that is between growth phase 2 and growth phase 7 is contacted more than once with the microbial preparation. In a particular embodiment, a plant that is between growth phase 5 and growth phase 7 is contacted more than once with the microbial preparation. In still another embodiment, a plant that is between growth phase 1 and growth phase 5 can be contacted more than once with a microbial preparation. In a final embodiment, a plant that is in growth phases 0-5, 7-9 can be contacted more than once with a microbial preparation. The interval between contacting can be between about 1 day and 21 days, for example between about 1 day and 2 days, between about 1 day and 3 days, between about 2 days and 4 days, between about 3 days and 6 days, between about 4 days and 7 days, between about 5 days and 10 days, between about 7 days and 14 days, or between about 10 days and 20 days.

There are some suggestions that pathogens may escape the plant's immune system at lower temperatures (see, for example, Szittya et al., (2003) EMBO J. 22: 633-640). Therefore, in some cases, the plants can be incubated at low temperature, for example at temperatures at or below 18° C., for example, at or below 15° C., at or below 12° C., at or below 10° C., at or below 8° C., for any period from the contacting step until maturation of seeds. In one embodiment, the plant is incubated at a low temperature for 1 day after contacting with the preparation of microbes. In another embodiment, the plant is incubated at a low temperature for 2 days after contacting the plant with the preparation of microbes. In still another embodiment, a plant is contacted at least twice with the preparation of microbes, and the plant is subjected to low temperature incubation for two days following each of the contacting steps.

Growing Plants from Seeds to Scale up Preserved Microbial Populations

The establishment of a stably integrated microbe population within the plant can be detected by a number of methods. The presence of the viable microbe within the seed and the plants and progeny derived from those seeds can be determined using the methods described herein.

In one embodiment, the resulting seeds, or the plant that is grown from such seeds, have a detectably altered chemical composition or metabolomic profile where the altered composition is due only to the presence of the microbe. In another embodiment, the resulting seeds, or the plant that is grown from such seeds, have a detectably altered gene expression profile that is linked to the presence of the microbe.

Plants can be grown individually to propagate the desired microbes in indoor or outdoor settings. An advantage of the present invention is that allows multiple plants to be grown under agricultural methods as a means of further increasing the quantity of a desired microbe that is produced.

Provided herein are indoor arrangments of populations of plants generated from the methods of the present invention. Such arrangements can include at least a defined number of plants of the present invention, such as at least 1, 2, 3, 5, 10, 15, 20, 30, 50, 100, 200, 500, 1000, 5000, or 10000 plants.

Also provided herein are agricultural fields that contain population of plants generated from the methods of the present invention. Agricultural fields can occupy as little as 100 square feet or less, or can occupy hundreds or thousands of acres. Area of field containing a population of microbe-associated plants can be measured in square feet, such as at least 100, 500, 1000, 5000, 10,000, 50,000 or greater than 50,000 square feet, or can be measured in acres, such as 1, 2, 3, 4, 5, 6, 7, 8, 9, 10, 25, 50, 100, 250, 500, 750, 1000, 5000, 10000, 50000 or greater than 50000 acres. The field can also be measured in hectares, for example at least 1, 5, 10, 20, 100, 300, 500, 1,000, 10,000 hectares or more. Additionally, a field containing a population of microbe-associated plants can be characterized by the number of plants in the population, generally a field is at least two, such as 1, 2, 3, 4, 5, 6, 7, 8, 9, 10, 25, 50, 100, 250, 500, 750, 1000, 5000, 10000, 50000, 100000, 250000, 500000, 750000, 1000000 or greater than 1000000 plants. A field is generally a contiguous area but may be separated by geographical features such as roads, waterways, buildings, fences, and the like known to those skilled in the art. Because the microbe-associated plants described herein benefit from an increased level of uniformity of germination and other characteristics, it is desirable to maximize the percentage of plants containing microbes. For example, at least 50% (e.g., 50%, 60%, 70%, 80%, 90%, 95%, 99% or greater than 99%) of the plants contain the microbes.

Plants Useful for the Methods of the Invention

The methods described herein are useful for producing a seed containing a microbe that is exogenous to the seed. The seed can be from any plant species that produces a seed (i.e., any spermatophyte). Suitable plants include both monocots and dicots (including eudicots) that can be colonized by the microorganisms according to the present invention. Preferably, the plant is a flowering plant (angiosperm) in order to most efficiently transfer the microorganisms to the seed. The resulting seeds contain the inoculated microbes at a detectable level. Plants grown from such seeds contain the microbes in part or all of their tissues, and the microbe may confer beneficial properties (e.g., enhanced growth, increased stress resilience, etc.) of the microbe can develop in the seeds or plants. Accordingly, the plants arising from such seeds—wherein the microbe can confer its beneficial function to the plant—may be at any stage of growth, including seeds, seedlings, or full plants. The present invention is therefore not limited to the application of microorganisms to a given plant (or seed) in order to provide the beneficial microbial effect only to this plant, but it provides a method which encapsulates and safeguards the presence of microbes in the seeds generated from this plant and therefore provides the microbes to the subsequent generations of the plant. This differs significantly from all other inoculation strategies attempted to date (seed impregnation, spraying the microorganisms to the seeds, germs or the whole plants), in that the present method deals with the production of seeds which contain a reproducible and heritable microbial microbial population.

The plant can be monocotyledonous. The plant can be dicotyledonous. In one embodiment, the plant is an agricultural plant. As used herein, an "agricultural plant" is a plant that is normally cultivated for agriculture to provide food, animal feed, fiber, or any other useful commodity product. In still another embodiment, the agricultural plant is a cereal plant.

In one embodiment, the target plant is a plant of the family Graminae (grasses). The grass plants into which these endophytes are introduced may be any of the useful grasses belonging to the genuses *Agropyron, Agrostis, Andropogon, Anthoxanthum, Arrhenatherum, Avena, Brachypodium, Bromus, Chloris, Cynodon, Dactylis, Elymus, Eragrostis, Festuca, Glyceria, Hierochloe, Hordeum, Lolium, Oryza, Panicum, Paspalum, Phalaris, Phleum, Poa, Setaria, Sorghum, Triticum, Zea* and *Zoysia*.

In another embodiment, the target plant is selected from the wheats, including, *Triticum monococcum, Triticum durum, Triticum turgidum, Triticum timopheevi* (Timopheevs Wheat) and *Triticum aestivum* (Bread Wheat).

In another embodiment, the target plant is a corn of the genus *Zea*. *Zea* is a genus of the family Gramineae (Poaceae), commonly known as the grass family. The genus consists of some four species: *Zea mays*, cultivated corn and teosinte; *Zea diploperennis* Iltis et at., diploperennial teosinte; *Zea luxurians* (Durieu et Asch.) Bird; and *Zea perennis* (Hitchc.) Reeves et Mangelsd., perennial teosinte.

Other useful grasses which may be used on an industrial basis are rye grasses and bluegrasses. Bluegrasses known in the art include Kentucky bluegrass, Canada bluegrass, rough meadow grass, bulbous meadow grass, alpine meadow grass, wavy meadow grass, wood meadow grass, Balforth meadow grass, swamp meadow grass, broad leaf meadow grass, narrow leaf meadow grass, smooth meadow grass, spreading meadow grass and flattened meadow grass.

In another embodiment, the plants for which seeds are produced by the method according to the present invention are dicots, including eudicots such as tomato, watermelon, squash, cucumber, strawberry, pepper, soybean, peanut, Brassicaceae, especially rape, sunflower, sugar beet, cotton, alfalfa and *Arabidopsis*.

Accordingly, in one embodiment, the plant is selected from the group of Graminae (grasses), including grasses of the genuses *Agropyron, Agrostis, Andropogon, Anthoxanthum, Arrhenatherum, Avena, Brachypodium, Bromus, Chloris, Cynodon, Dactylis, Elymus, Eragrostis, Festuca, Glyceria, Hierochloe, Hordeum*, including *Hordeum vulgare* L., *Hordeum distichon* L., and *Hordeum irregulare, Lolium, Oryza, Panicum, Paspalum, Phalaris, Phleum, Poa, Setaria, Sorghum, Triticum, Zea*, especially *Zea mays*, cultivated corn and teosinte, *Zea diploperennis* Iltis et at., diploperennial teosinte, *Zea luxurians* (Durieu et Asch.) Bird; and *Zea perennis* (Hitchc.) Reeves et Mangelsd., perennial teosinte .and *Zoysia*; wheats, including *Triticum monococcum, Triticum turgidum, Triticum timopheevi* (Timopheevs Wheat) and *Triticum aestivum* (Bread Wheat); rye grasses and bluegrasses, especially Kentucky bluegrass, Canada bluegrass, rough meadow grass, bulbous meadow grass, alpine meadow grass, wavy meadow grass, wood meadow grass, Balforth meadow grass, swamp meadow grass, broad leaf meadow grass, narrow leaf meadow grass, smooth meadow grass, spreading meadow grass and flattened meadow grass; dicots, including eudicots, for example tomato, watermelon, squash, cucumber, strawberry, pepper, soybean, peanut, Brassicaceae, especially rape, sunflower, sugar beet, cotton, alfalfa and *Arabidopsis*.

Cultivars

The present invention contemplates the use of commercial cultivars of agricultural plants. The microbes described herein can be inoculated with such commercial cultivars using the methods provided herein. Non-limiting examples of commercial cultivars are provided below.

Maize

Exemplary *Zea* cultivars provided herein include 39V07, 38H03AM1, P9675, P9675YXR, P9630AM1, P9990AM1, P9917, P9917AM1, P9910AM1, P9910AMRW, P9910AMX, P9910XR, P0062AMX, P0062XR, P0193AM, P0193HR, P0216HR, P0210HR, 36V51, 36V52, 36V53, 36V59, P0313AM1, P0313XR, P0463AM1, P0461AMX, P0461EXR, P0461XR, P0453AM, P0453HR, P0448, P0448AMRW, P0448AMX, P0448E, P0448EHR, P0448R, P0413AM1, P0413E, P0407AMXT, P0533AM1, P0533EXR, P0528AMX, P0528YXR, 35F40, P0652AMX, P0636AM1, P0636HR, P0621HR, P0621R, P0717HR, P0832AM1, P0832E, P0832EXR, P0832XR, 34F29, P0993AM1, P0993HR, P0993XR, P0987AM1, P0987HR, P0916EHR, 34R6, 7P1023AM-R, P1018EHR, P1018HR, 34F06, 34F07, P1184, P1162AM1, P1162AMRW-R, P1162AMX-R, P1162EXR, P1162XR, P1151AM, P1151AM1, P1151R, P1142AMX, 33W80, 33W82, 33W84, 33W88AM1, P1281HR, P1253E, P1248AM, P1221AMX, P1221AMXT, P1215AM1, P1395, P1395AM1, P1395HR, P1395R, P1376XR, P1365AMX, P1360CHR, P1360HR, P1339AM1, P1324HR, 33Z74, 33T56, 33T57, 33M16, P1498, P1498AM, P1498HR, P1498R, P1480HR, P1477WHR, P1431W, P1431WR, P1420HR, 33G61, 33F12, P1555CHR, 33D42, 33D46, 33D49, P1659W, P1659WHR, 32D78, P1745HR, 32B16, P1995W, and P2088HR from Pioneer Hi-Bred, which are grown in geographical entities including Iowa.Exemplary *Zea* cultivars provided herein include P0115AM1, P0392AMX, P0496AMX, P0432AM1, P0413AM1, P0413AMRW, P0413E, P0413R, P0533AM1, P0636AM1, P0636YXR, 35K01, 35K02, 35K08, 35K09AM1, 35K10AMRW, 34M78, P0858AMX, P0832AMRW, P0832AMX, P0832E, P0832EXR, P0832R, P0993AM1, P0993HR, P0987AM1, P0987YXR, P0945YXR, P0916EHR, 34R65, P1023AM-R, P1023AMX-R, P1018AM, P1018AM1, P1018AMX, P1018E, P1018R, P1184, P1184AM, P1184AM1, P1184AMRW, P1184R, P1162AM1, P1162AMRW-R, P1162AMX-R, P1162EXR, P1151AM, P1151AM1, 34P91, P1292AMX, P1241AMX, P1221AMX, P1221AMXT, P1215AM1, P1395AM1, P1395AMRW, P1376XR, P1360CHR, P1360HR, P1352AMX, P1339AM1, P1319, P1319AM1, P1319HR, 33T55, 33T56, P1498, P1498AM, P1498CHR, P1498HR, P1498R, P1477W, P1477WHR, P1449XR, P1431W, P1431WR, 33F12, 33D42, P1690HR, P1659W, 32B09, 32B10, 32B16, P1995W, P1995WR, and P2088AM from Pioneer Hi-Bred, which are grown in geographical entities including Illinois.

Exemplary *Zea* cultivars provided herein include P8917XR, P9690AM, P9690HR, P0125R, P0231HR, P0365YHR, P0302CHR, P0474AM1, P0461EXR, P0591AM1, P0541AM1, P0541HR, 35F37, 35F38, 35F48AM1, 35F50AM, P0636AM1, P0636HR, P0636YXR, P0621HR, 35K01, P0876AM, P0876CHR, P0876HR, P0987, P0987AM, P0987AM1, P0987HR, P0987R, P0987YXR, P0916EHR, P0902AM1, P1023AM-R, P1023AMX-R, P1018EHR, P1173AM, P1173CHR, P1173HR, P1173R, P1151AM, P1151AM1, P1151HR, P1151R, P1151YXR, P1105YHR, P1292ER, P1266YHR, P1395AM, P1395AM1, P1395R, P1376XR, P1360HR, P1324HR, P1498AM, P1498AM1, P1498HR, P1498R, P1477W, P1477WHR, P1449XR, P1431W, 33G60, 33G61, 33F12, P1508CHR, 32T16, 33D42, 33D46, 33D47, 33D49, 33D53AM-R, 32T82, 32T84, P1690AM, P1690CHR, P1690HR, P1659W, P1659WHR, P1625CHR, P1625HR, P1768AMX, 32N74AM1, 32B09, 32B10, 32B11, 32B16, P1995W, P1995WR, 31G67AM1, 31G71, P2088AM, P2088YHR, and P2088YXR from Pioneer Hi-Bred, which are grown in geographical entities including Nebraska.

Exemplary *Zea* cultivars provided herein include P9690HR, P0115AM1, P0216HR, P0448E, P0432AM1, P0413AM1, P0413E, P0636AM1, P0636HR, P0636YHR, P0621HR, 35K01, 35K02, 35K08, 35K09AM1, 35K10AMRW, 34M78, P0858AMX, P0832AMX, P0832E, P0832R, P0993AM1, P0993HR, P0987, P0987AM, P0987AM1, P0987HR, P0987YXR, P0945YXR, P0916EHR, P1023AM-R, P1023AMX-R, P1018AM, P1018AM1, P1018AMX, P1018E, P1018R, P1184, P1184AM, P1184AM1, P1184R, P1162AM1, P1162AMRW-R, P1162AMX-R, P1151AM, P1151AM1, P1105YHR, 34P91, P1253E, P1221AMX, P1221AMXT, P1395, P1395AMRW, P1395HR, P1395R, P1376XR, P1360AM, P1360HR, P1352AMX, P1339AM1, P1319, P1319AM1, P1319HR, 33T54, 33T55, 33T56, 33T57, 33N58, P1498, P1498AM, P1498CHR, P1498HR, P1498R, P1477W, P1477WHR, P1449XR, P1431W, P1431WR, 33G60, 33F12, P1659W, P1659WHR, P1646YHR, P1636AM, P1636YHR, P1602YHR, 32D78, 32D79, P1745HR, 32B09, 32B10, 32B16, P1995W, P1995WR, 31P41, and P2088AM from Pioneer Hi-Bred, which are grown in geographical entities including Indiana.

Exemplary *Zea* cultivars provided herein include Genuity® SmartStax® RIB Complete®, including DKC48-12RIB Brand, DKC49-29RIB Brand, DKC53-56RIB Brand, DKC62-08RIB Brand, DKC63-33RIB Brand; DEKALB® Genuity® DroughtGard™ Hybrids, including DKC47-27RIB Brand, DKC50-57RIB Brand, DKC51-20RIB Brand, DKC63-55RIB Brand, DKC65-81RIB Brand; <89 Relative Maturity, including DKC31-10RIB Brand, DKC32-92RIB Brand, DKC33-78RIB Brand, DKC38-03RIB Brand, DKC39-07RIB Brand; 90-99 Relative Maturity, including DKC43-10RIB Brand, DKC44-13RIB Brand, DKC46-20RIB Brand, DKC48-12RIB Brand, DKC49-29RIB Brand; 101-103 Relative Maturity, including DKC51-20RIB Brand, DKC52-30RIB Brand, DKC53-56RIB Brand, DKC53-58RIB Brand, DKC53-78RIB Brand; 104-108 Relative Maturity, including DKC54-38RIB Brand, DKC57-75RIB Brand, DKC57-92RIB Brand, DKC58-87RIB Brand, DKC58-89RIB Brand; 110-111 Relative Maturity, including DKC60-63RIB Brand, DKC60-67RIB Brand, DKC61-16RIB Brand, DKC61-88RIB Brand, DKC61-89RIB Brand; 112-113 Relative Maturity, including DKC62-08RIB Brand, DKC62-97RIB Brand, DKC63-07RIB Brand, DKC63-33RIB Brand, DKC63-55RIB Brand; 114-116 Relative Maturity, including DKC64-69RIB Brand, DKC64-87RIB Brand, DKC65-19RIB Brand, DKC65-79RIB Brand, DKC66-40RIB Brand; 117+ Relative Maturity, including DKC67-57RIB Brand, DKC67-58RIB Brand, DKC67-88RIB Brand, DKC68-05 Brand, and DKC69-29 Brand from DEKALB®, which are grown in geographical entities including the United States.

Soybean

Exemplary soybean cultivars provided herein include 900Y71, 90Y42, P05T24R, 90Y80, 91M01, 91Y01, P10T91R, 91M10, 91Y20, 91Y61, 91Y90, P19T01R, 92Y12, 92Y21, 92Y31, 92Y32, P24T19R, 92Y51, 92Y91, 93M11, and 93Y22 from Pioneer Hi-Bred, which are grown in geographical entities including Iowa.

Exemplary soybean cultivars provided herein include 92Y51, 92Y53, P25T51R, P26T76R, 92M72, 92Y75, 92Y80, P28T33R, 93Y05, 93Y15, 93Y20, 93Y21, 93Y25, 93M42, 93Y40, 93Y41, 93Y43, P34T35L, P35T58R, 93Y60, 93Y72, 93B82, 93Y82, 93Y84, 93L71, P39T67R, 94Y01, 94Y21, 94Y23, 94Y50, 94Y70, and 95Y10 from Pioneer Hi-Bred, which are grown in geographical entities including Illinois.

Exemplary soybean cultivars provided herein include 91Y90, 92Y22, P24T19R, 92Y53, 92Y62, 92M72, 92Y70, 92Y73, 92Y83, 93M11, 93Y13, 93Y15, 93M43, 93Y41, 93Y52, P35T58R, 93M61, 93Y70, 93Y72, 93B82, 93Y84, 93Y92, P39T67R, 94Y01, and 94Y02 from Pioneer Hi-Bred, which are grown in geographical entities including Nebraska.

Exemplary soybean cultivars provided herein include 90Y51, 90Y90, 92Y51, 92Y75, 92Y80, P28T33R, 93Y05, 93Y11, 93Y20, 93Y21, 93Y22, 93Y23, P33T89R, 93M42, 93Y40, 93Y41, 93Y43, P34T35L, 93Y51, 93Y53, P35T58R, 93Y60, 93Y72, 93B82, 93Y82, 93Y84, 93L71, 93Y91, 93Y92, P39T67R, 94Y01, 94Y02, 94L21, 94Y21, 94Y22, 94Y23, 94L51, P43T14L, P44T82SR, 94Y50, P46T21R, 94Y70, P47T36R, 94Y80, and P48T53R from Pioneer Hi-Bred, which are grown in geographical entities including Indiana.

Exemplary soybean cultivars provided herein include AG 0231 GENRR2Y, AG 0333 GENRR2Y, AG 0430 GENRR2Y, AG 0532 GENRR2Y, AG 0732 GENRR2Y, AG 0832 GENRR2Y, AG 0833 GENRR2Y, AG 1031 GENRR2Y, AG 1132 GENRR2Y, AG 1230 GENRR2Y, AG 1233 GENRR2Y, and AG 1431 GENRR2Y from Asgrow, which are grown in geographical entities including the United States.

Exemplary soybean cultivars provided herein include S06-H5, S08-G1, S10-G7, S10-P9, S12-L5, S14-J7, S17-B3, S17-G8, S18-C2, S20-T6, S20-Y2, S22-F8, S22-S1, S23-P8, S24-K2, S25-E5, S27-H6, S28-A2, S28-K1, S28-U7, S29-V2, S30-E9, S34-N3, S34-Z1, S35-C3, S36-M8, S17-B3, S18-C2, S20-T6, S20-Y2, S22-F8, S22-S1, S24-K2, S25-E5, S27-H6, S28-A2, S28-U7, S29-V2, S30-E9, S31-L7, S34-N3, S34-Z1, S35-C3, S36-M8, S37-B1, S38-S4, S38-W4, S39-U2, S41-J6, S42-W9, S43-K1, and S44-K7 from Syngenta, which are grown in geographical entities including the United States.

Wheat

Exemplary *Triticum* cultivars provided herein include Everest, TAM 111, Armour, TAM 112, Fuller, Duster, T158, Postrock, Endurance, Jagger, Winter Hawk, Art, Overley, Jagalene, Jackpot, Hatcher, Santa Fe, Danby, Billings, T81, TAM 110, AP503 CL2, Aspen, 2137, TAM 113, Hitch, TAM 101, CJ, Centerfield, SY Gold, and Above, which are grown in geographical entities including Kansas.

Exemplary *Triticum* cultivars provided herein include Barlow, Glenn, SY Scren, Faller, Prosper, Kelby, Brennan, RB07, Vantage, WB Mayville, Freyr, Jenna, Mott, Select, Steele-ND, Briggs, Howard, Reeder, Alsen, Rollag, Divide, Alkabo, Mountrail, Tioga, Lebsock, Grenora, Dilse, Ben, DG Max, Pierce, Monroe, DG Star, Jerry, Decade, Hawken, Wesley, Overland, CDC Falcon, SY Wolf, Harding, Darrell, WB Matlock, Millennium, and Boomer, which are grown in geographical entities including N. Dakota.

Exemplary *Triticum* cultivars provided herein include Yellowstone, Genou, CDC Falcon, Rampart, Ledger, Jerry, AP503 CL2, Hawken, Norris, Pryor, Jagalene, Carter, Morgan, Decade, WB Quake, Tiber, Willow Creek, Radiant, Neeley, Vanguard, Promontory, Overland, and Redwin, which are grown in geographical entities including Montana.

Exemplary *Triticum* cultivars provided herein include Duster, Endurance, Jagger, Fuller, OK Bullet, Jackpot, Everest, Billings, TAM 112, TAM 111, Big Max, Overley, Doans, Armour, Santa Fe, Garrison, Deliver, TAM 110, CJ, 2157, Custer, 2137, Scout, Centerfield, Triumph varieties, Dumas, TAM 401, Gallagher, Cutter, T-158, Ike, WB Hitch, Greer, AP 503 CL2, Ruby Lee, Pioneer 2548, Pioneer 2571, and Coker 762, which are grown in geographical entities including Oklahoma.

Exemplary *Triticum* cultivars provided herein include UI Stone, Diva, Petit, Jubilee, Louise, Alturas, Whit, Babe, Cataldo, Alpowa, BrundageCF, Brundage96, Bitterroot, Kaseberg, Amber, Bruneau, AP Legacy, Salute, Ladd, Junction, ORCF101, Mary, Masami, SY Ovation, Skiles, Rod, WB523, Legion, Eltan, WB528, Stephens, Otto, ORCF103, Rosalyn, Madsen, AP Badger, LCS Artdeco, ORCF102, Lambert, Goetze, WB456, WB1020M, AP700CL, Xerpha, Tubbs06, WB1066CL, Eddy, Finley, Juniper, Whetstone, Sprinterl, Paladin, DW, Buchanan, Farnum, Northwest 553, Peregrine, Rimrock, Declo, Esperia, Boundary, Bauermeister, Residence, Symphony, and Estica, which are grown in geographical entities including Washington state.

Exemplary *Triticum* cultivars provided herein include Wesley, Overland, Expedition, Clearfield, Smoky Hill, Arapahoe, Lyman, Hawken, Millenium, Jagalene, CDC Falcon, Alliance, Nekota, Briggs, RB07, Brick, Faller, Howard, Select, Traverse, Steele ND, Forge, Barlow, Butte86/Butte, Granger, Brennan, which are grown in geographical entities including South Dakota.

Barley

Exemplary barley cultivars provided herein include Azure, Beacon, Bere, Betzes, Bowman, Celebration, Centennial, Compana, Conlon, Diamant, Dickson, Drummond, Excel, Foster, Glenn, Golden Promise, Hazen, Highland barley, Kindred, Kindred L, Larker, Logan, Lux, Manchurian, Manscheuri, Mansury, Maris Otter, Morex, Nordal, Nordic, Optic, Park, Plumage Archer, Pearl, Pinnacle, Proctor, Pioneer, Rawson, Robust, Sioux, Stark, Tradition, Traill, Tregal, Trophy, Windich, and Yagan, which are grown throughout the world.

Exemplary barley cultivars provided herein include Tradition, Lacey, Robust, Celebration, Conlon, Pinnacle, Haybet, Legacy, Stellar-D, Innovation, Hays, Quest, Bowman, and Logan, which are grown in geographical entities including North Dakota.

Exemplary barley cultivars provided herein include AC METCALFE, HARRINGTON, CONRAD (B5057), LEGACY (B2978), MORAVIAN 69 (C69), MERIT (B4947), TRADITION (B2482), MORAVIAN 83 (C83), and CHARLES, which are grown in geographical entities including Idaho.

Exemplary barley cultivars provided herein include Harrington, Haybet, B 1202, Moravian, Baronesse, Hector, Bowman, Westford, B Merit, Gallatin, Horsford, Lewis, Stark, Piroline, Valier, B 2601, Legacy, Menuet, Robust, Chinook, and Clark, which are grown in geographical entities including Montana.

Exemplary barley cultivars provided herein include Champion, Bob, Baronesse, Radiant, Haybet, Belford, Camelot, BG, Camas, Gallatin, Copeland, AC Metcalfe, and Harrington, which are grown in geographical entities including Washington state.

Exemplary barley cultivars provided herein include Moravian 69, C-115, C-128, Scarlett, Baronesse, Hays, and Steptoe, which are grown in geographical entities including Colorado.

Cotton

Exemplary *Gossypium* cultivars provided herein include Deltapine DP 1044 B2RF, DP 1252 B2RF, DP 1050 B2RF, and DP 1219 B2RF; Fibermax FM 2484 B2F, FM 9063 B2F, FM 1944 GLB2, and FM 1740 B2F; Phytogen PHY 499 WRF, PHY 375 WRF, and PHY 367 WRF; Americot NG 4111RF, NG 1511 B2RF, and NG 3348 B2RF; Stoneville varieties; Dyna-Gro varieties; and All-Tex varieties, which are varieties of upland cotton (*Gossypium hirsutum*).

Exemplary *Gossypium* cultivars provided herein include Phytogen PHY 805 RF, Phytogen PHY 802 RF, and Deltapine DP 340, which are varieties of pima cotton (*Gossypium barbadense*).

Exemplary *Gossypium* cultivars provided herein include Bayer CropScience FM 958; AFD 2485; Deltapine 340; All-Tex A102, All-Tex 7A21, All-Tex LA122; Americot UA48; Bayer CropScience FM 989; Downer Cotton Genetics DCG 1374; Seed Source Genetics CT 210; and Stoneville LA 887, which are varieties of cotton planted by organic farmers.

Genetically Modified Plants

The methods described herein can also be used with genetically modified plants, for example, to allow the use of current commercial cultivars of crops where the use of genetically modified plants is common. For example, a genetically modified plant which is, by means of the transgene, optimized with respect to a certain trait, can be used as a bioreactor to propagate the newly introduced microbe and its seeds can be used as storage vehicles for the microbe. Therefore, in one embodiment, a genetically modified plant is contacted with a microbe. The genetically modified plant can be any one of the plants described in Table H.

Pre-Treating Plants to Reduce Carriage of Endogenous Microbes

In some cases, it may be beneficial or preferable to use plants that are modulated to reduce their carriage of endogenous microbes. As used herein, a plant that is depleted, sterilized, or reduced in its carriage of an endogenous microbe is one in which some, substantially all, or all of the endogenous microbiota that reside within the plant are removed. Microbes within a plant are typically resistant to surface sterilization by chemical agents such as detergents, bleach (sodium hypochloritehypochlorite), hydrogen peroxide, or ethanol, which do not penetrate the surface of the plant in sufficient amounts. Surface sterilization of seeds, for example, is a convenient means to distinguish between surface-residing microbes (which are sensitive to surface sterilization), and endogenous microbes (which are resistant to such methods of surface sterilization). In order to remove (i.e., kill) some, substantially all, or all of the endogenous microbes, additional treatments are required. For example, in one embodiment, a plant or a part thereof (including a seed) can be treated with an antibacterial agent that has sufficient permeability to enter the plant tissues and kill or hinder endogenous bacteria. One of ordinary skill in the art will appreciate that such agents should ideally be agents that do not compromise the viability of the plant, at least at the concentration used. The agent should also have a broad spectrum to target as many bacteria as possible. In the alternative, a combination of antibacterial agents can be used. A non-limiting list of antibiotics is found in Table G.

In one embodiment, the plant or part thereof is contacted with an antibacterial agent selected from the group consisting of: Amikacin, Gentamicin, Kanamycin, Neomycin, Netilmicin, Tobramycin, Paromomycin, Spectinomycin, Ansamycins, Geldanamycin, Herbimycin, Rifaximin, streptomycin, Carbacephem, Loracarbef, Carbapenems, Ertapenem, Doripenem, Imipenem/Cilastatin, Meropenem, Cefadroxil, Cefazolin, Cefalotin or Cefalothin, Cefalexin, Cefaclor, Cefamandole, Cefoxitin, Cefprozil, Cefuroxime, Cefixime, Cefdinir, Cefditoren, Cefoperazone, Cefotaxime, Cefpodoxime, Ceftazidime, Ceftibuten, Ceftizoxime, Ceftriaxone, Cefepime, Ceftaroline fosamil, Ceftobiprole, Glycopeptides, Teicoplanin, Vancomycin, Telavancin, Lincosamides, Clindamycin, Lincomycin, Lipopeptide, Daptomycin, Azithromycin, Clarithromycin, Dirithromycin, Erythromycin, Roxithromycin, Troleandomycin, Telithromycin, Spiramycin, Monobactams, Aztreonam, Nitrofurans, Furazolidone, Nitrofurantoin, Linezolid, Posizolid, Radezolid, Torezolid, Amoxicillin, Ampicillin, Azlocillin, Carbenicillin, Cloxacillin, Dicloxacillin, Flucloxacillin, Mezlocillin, Methicillin, Nafcillin, Oxacillin, Penicillin G, Penicillin V, Piperacillin, Penicillin G, Temocillin, Ticarcillin, Penicillin combinations, Amoxicillin/clavulanate, Ampicillin/sulbactam, Piperacillin/tazobactam, Ticarcillin/clavulanate, Polypeptides, Bacitracin, Colistin, Polymyxin B, Ciprofloxacin, Enoxacin, Gatifloxacin, Levofloxacin, Lomefloxacin, Moxifloxacin, Nalidixic acid, Norfloxacin, Ofloxacin, Trovafloxacin, Grepafloxacin, Sparfloxacin, Temafloxacin, Mafenide, Sulfacetamide, Sulfadiazine, Silver sulfadiazine, Sulfadimethoxine, Sulfamethizole, Sulfamethoxazole, Sulfanilimide (archaic), Sulfasalazine, Sulfisoxazole, Trimethoprim-Sulfamethoxazole (Co-trimoxazole) (TMP-SMX), Sulfonamidochrysoidine (archaic), Demeclocycline, Doxycycline, Minocycline, Oxytetracycline, Tetracycline Clofazimine, Dapsone, Capreomycin, Cycloserine, Ethambutol, Ethionamide, Isoniazid, Pyrazinamide, Rifampicin (Rifampin in US), Rifabutin, Rifapentine, Streptomycin, Arsphenamine, Chloramphenicol, Fosfomycin, Fusidic acid, Metronidazole, Mupirocin, Platensimycin, Quinupristin/Dalfopristin, Thiamphenicol, Tigecycline, Tinidazole, and Trimethoprim.

In another embodiment, a plant or a part thereof (including a seed) is treated with an antifungal agent. In one embodiment the plant or part thereof is cured of some, substantially all, or all of the endogenous fungal microbes by contacting with an antifungal agent. In one embodiment, the antifungal agent is selected from the group consisting of: Polyene antifungals (Amphotericin B, Candicidin, Filipin, Hamycin, Natamycin, Nystatin, Rimocidin); Imidazole, triazole, and thiazole antifungals (Canesten (clotrimazole), Bifonazole, Butoconazole, Clotrimazole, Econazole, Fenticonazole, Isoconazole, Ketoconazole, Miconazole, Omoconazole, Oxiconazole, Sertaconazole, Sulconazole, Tioconazole, Albaconazole, Fluconazole, Isavuconazole, Itraconazole, Posaconazole, Ravuconazole, Terconazole, Voriconazole, Abafungin), Allylamines (Amorolfin, Butenafine, Naftifine, Terbinafine), Echinocandins (Anidulafungin, Caspofungin, Micafungin), Benzoic acid, Ciclopirox, Flucytosine or 5-fluorocytosine, Griseofulvin, Haloprogin, Polygodial, Tolnaftate, Undecylenic acid and Crystal violet.

It will be appreciated by one of skill in the art that some plants may contain both bacterial and fungal endogenous microbes. As such, in one embodiment, a plant or part thereof is contacted with a combination of an antibacterial agent and an antifungal agent.

As described herein, the antimicrobial agents (whether antibacterial or antifungal) are contacted with the plant or part thereof at a dosage, and for a time, sufficient to kill the endogenous microbes. The elimination of endogenous microbes can be monitored by removing a portion of the plant at various times, homogenizing the tissue, and plating the homogenate on media that support bacterial and/or fungal growth. Alternatively, after contacting the plant or part thereof with the antimicrobial agent, the plant can be allowed to grow in a sterile environment for a certain time before removing a portion of the plant. The tissue is then tested for the presence of microbial DNA by, for example, PCR using primers specific for bacteria or *fungi*.

Seed Coating Compositions

The seeds generated using the methods described herein can be further treated. Many commercial seeds are treated on the surface to contain a seed coating composition order to reduce yield losses during cultivation and to enhance the agronomic and nutritional value of the produce. As such, in one embodiment, the seeds are coated with a seed coating composition; the agent can be selected from the group consisting of a control agent, a plant growth regulator, and a fertilizer/nutrient. As used herein, agents used for eliminating or reducing the damage caused by a pathogen or pest on the plant or seed are referred to as a "control agent". A control agent includes such agents that can be used to kill or repel a pest or pathogen, including a fungus, bacterium, insect, nematode, or bird. In one embodiment, the seed is treated with a control agent, which is selected from the group consisting of fungicides, insecticides, rodenticides, nematocides, miticides or bird repellents, a plant growth regulator and a fertilizer/nutrient.

Fungicide

In one embodiment, the control agent is a fungicide. As used herein, a fungicide is any compound or agent (whether chemical or biological) that can either inhibit the growth of a fungus or kill a fungus. In that sense, a "fungicide", as used herein, encompasses compounds that may be fungistatic or fungicidal. As used herein, the fungicide can be a protectant, or agents that are effective predominantly on the seed surface, providing protection against seed surface-borne pathogens and providing some level of control of soil-borne pathogens. Non-limiting examples of protectant fungicides include captan, maneb, thiram, or fludioxonil.

The fungicide can be a systemic fungicide, which can be absorbed into the emerging seedling and inhibit or kill the fungus inside host plant tissues. Systemic fungicides used for seed treatment include, but are not limited to the following: azoxystrobin, carboxin, mefenoxam, metalaxyl, thiabendazole, trifloxystrobin, and various triazole fungicides, including difenoconazole, ipconazole, tebuconazole, and triticonazole. Mefenoxam and metalaxyl are primarily used to target the water mold *fungi* Pythium and *Phytophthora*. Some fungicides are preferred over others, depending on the plant species, either because of subtle differences in sensitivity of the pathogenic fungal species, or because of the differences in the fungicide distribution or sensitivity of the plants.

A fungicide can be a biological control agent, such as a bacterium or fungus. Such organisms may be parasitic to the pathogenic *fungi*, or secrete toxins or other substances which can kill or otherwise prevent the growth of *fungi*.

Any type of fungicide, particularly ones that are commonly used on plants, can be used as a control agent in a seed composition. Non-limiting examples of chemical fungicides that can be used are shown in Table I. In another embodiment, the fungicide is selected from the group listed on Table J.

Antibacterial Compositions

In some cases, the seed coating composition comprises a control agent which has antibacterial properties. In one embodiment, the control agent with antibacterial properties is selected from the compounds listed in Table G. In another embodiment, the compound is Streptomycin, oxytetracycline, oxolinic acid, or gentamicin.

Herbicide

In some cases, an herbicide can be included in the seed coating composition. Non-limiting examples of herbicides which can be used as a control agent of the seed coating application are listed in Table K.

Plant Growth Regulators

In still other embodiments, the seed coat composition comprises a plant growth regulator. The plant growth regulator can be selected from the group provided in Table L. In another embodiment, the plant growth regulator is selected from the group consisting of: Abscisic acid, amidochlor, ancymidol, 6-benzylaminopurine, brassinolide, butralin, chlormequat (chlormequat chloride), choline chloride, cyclanilide, daminozide, dikegulac, dimethipin, 2,6-dimethylpuridine, ethephon, flumetralin, flurprimidol, fluthiacet, forchlorfenuron, gibberellic acid, inabenfide, indole-3-acetic acid, maleic hydrazide, mefluidide, mepiquat (mepiquat chloride), naphthaleneacetic acid, N-6-benzyladenine, paclobutrazol, prohexadione (prohexadione-calcium), prohydrojasmon, thidiazuron, triapenthenol, tributyl phosphorotrithioate, 2,3,5-tri-iodobenzoic acid, trinexapac-ethyl and uniconazole. Other examples of antibacterial compounds which can be used as part of a seed coating composition include those based on dichlorophene and benzylalcohol hemi formal (Proxel® from ICI or Acticide® RS from Thor Chemie and Kathon® MK from Rohm & Haas) and isothiazolinone derivatives such as alkylisothiazolinones and benzisothiazolinones (Acticide® MBS from Thor Chemie). Other plant growth regulators that can be incorporated seed coating compositions are described in US 2012/0108431, which is incorporated by reference in its entirety.

Insecticide

In some cases, the seed coating composition can comprise an insecticide as a control agent. Any insecticide commonly used in agriculture can be used as a control agent. In one embodiment, the insecticide is selected from the group listed in Table M.

Nematicide

Preferred nematode-antagonistic biocontrol agents include ARF18; *Arthrobotrys* spp.; *Chaetomium* spp.; *Cylindrocarpon* spp.; *Exophilia* spp.; *Fusarium* spp.; *Gliocladium* spp.; *Hirsutella* spp.; *Lecanicillium* spp.; *Monacrosporium* spp.; *Myrothecium* spp.; *Neocosmospora* spp.; *Paecilomyces* spp.; *Pochonia* spp.; *Stagonospora* spp.; vesicular-arbuscular mycorrhizal *fungi*, *Burkholderia* spp.; *Pasteuria* spp., *Brevibacillus* spp.; *Pseudomonas* spp.; and *Rhizobacteria*.

Particularly preferred nematode-antagonistic biocontrol agents include ARF18, *Arthrobotrys oligospora, Arthrobotrys dactyloides, Chaetomium globosum, Cylindrocarpon heteronema, Exophilia jeanselmei, Exophilia pisciphila, Fusarium aspergilus, Fusarium solani, Gliocladium catenulatum, Gliocladium roseum, Gliocladium vixens, Hirsutella rhossiliensis, Hirsutella minnesotensis, Lecanicillium lecanii, Monacrosporium drechsleri, Monacrosporium gephyropagum, Myrotehcium verrucaria, Neocosmospora vasinfecta, Paecilomyces lilacinus, Pochonia chlamydosporia, Stagonospora heteroderae, Stagonospora phaseoli*, vesicular-arbuscular mycorrhizal *fungi, Burkholderia cepacia, Pasteuria penetrans, Pasteuria thornei, Pasteuria nishizawae, Pasteuria ramosa, Pastrueia usage, Brevibacillus laterosporus* strain G4, *Pseudomonas fluorescens* and *Rhizobacteria*. In one embodiment, the nematicide is selected from the group listed in Table N.

Nutrients/Fertilizers

In another embodiment, the seed coating composition can comprise a nutrient. The nutrient can be selected from the group consisting of a nitrogen fertilizer including, but not limited to Urea, Ammonium nitrate, Ammonium sulfate, Non-pressure nitrogen solutions, Aqua ammonia, Anhydrous ammonia, Ammonium thiosulfate, Sulfur-coated urea, Urea-formaldehydes, IBDU, Polymer-coated urea, Calcium nitrate, Ureaform, and Methylene urea, phosphorous fertilizers such as Diammonium phosphate, Monoammonium phosphate, Ammonium polyphosphate, Concentrated superphosphate and Triple superphosphate, and potassium fertilizers such as Potassium chloride, Potassium sulfate, Potassium-magnesium sulfate, Potassium nitrate. Such compositions can exist as free salts or ions within the seed coat composition. Alternatively, nutrients/fertilizers can be complexed or chelated to provide sustained release over time.

Rodenticide

Rodents such as mice and rats cause considerable economical damage by eating and soiling planted or stored seeds. Moreover, mice and rats transmit a large number of infectious diseases such as plague, typhoid, leptospirosis, trichinosis and salmonellosis.

Anticoagulants such as coumarin and indandione derivatives play an important role in the control of rodents. These active ingredients are simple to handle, relatively harmless to humans and have the advantage that, as the result of the delayed onset of the activity, the animals being controlled identify no connection with the bait that they have ingested, therefore do not avoid it. This is an important aspect in particular in social animals such as rats, where individuals act as tasters.

In one embodiment, the seed coating composition comprises a rodenticide selected from the group of substances consisting of 2-isovalerylindan-1,3-dione, 4-(quinoxalin-2-ylamino)benzenesulfonamide, alpha-chlorohydrin, aluminium phosphide, antu, arsenous oxide, barium carbonate, bisthiosemi, brodifacoum, bromadiolone, bromethalin, calcium cyanide, chloralose, chlorophacinone, cholecalciferol, coumachlor, coumafuryl, coumatetralyl, crimidine, difenacoum, difethialone, diphacinone, ergocalciferol, flocoumafen, fluoroacetamide, flupropadine, flupropadine hydrochloride, hydrogen cyanide, iodomethane, lindane, magnesium phosphide, methyl bromide, norbormide, phosacetim, phosphine, phosphorus, pindone, potassium arsenite, pyrinuron, scilliroside, sodium arsenite, sodium cyanide, sodium fluoroacetate, strychnine, thallium sulfate, warfarin and zinc phosphide.

It is, of course, also possible to provide a coating with additional microorganisms (either the same or different as the microbe that was inoculated). Therefore, according to another embodiment of the present invention, the obtained plant seed containing microorganisms is therefore subjected to a further seed impregnation step.

Preparation of Commercial Seeds

In another aspect, methods for the production of a uniform population of the seeds at a commercial scale are provided. The method comprises planting a plurality of parental seeds containing the microbe using the methods described herein, germinating the seeds and growing the resulting plants to maturity, and collecting commercial seeds from the plants. In one embodiment, the microbe population in at least 70%, for example, at least 75%, at least 80%, at least 90%, at least 95% or more of the commercial seeds is substantially the same. In some cases, the seeds are considered substantially the same when at least 70% of the seeds, for example, at least 75%, at least 80%, at least 90%, at least 95% or more of the seeds contains the microbe. In another embodiment, the commercial seeds are considered substantially the same when at least at least 70% of the seeds, for example, at least 75%, at least 80%, at least 90%, at least 95% or more of the seeds contains at least 10 CFU, for example, at least 100 CFU, at least 300 CFU, at least 1,000 CFU, at least 3,000 CFU or more, of the microbe.

Optionally, the method can also include an additional step of contacting the resulting plants with a synthetic preparation of the microbes. The above cycle of planting seeds containing the desired microbe can be performed multiple times in succession in order to produce enough seeds for large-scale production of the microbe within agricultural settings. In these circumstances, samples of seeds can be checked at each generation to ensure uniformity of seeds as described above. Additional steps can be taken to enhance the probability that the seeds contain the desired microbes. In one embodiment, plants can be further contacted with microbes at each generation using the methods described herein. In another embodiment, the soil on which plants are grown can be enriched with the desired microbes. In still another embodiment, the seeds are coated with the desired microbes before replanting to produce the next generation of seeds. Where the final plant 'bioreactor' is an F1 hybrid, such as is the case with maize, the two parental inbred strains are grown in the field in adjacent rows and the female line has its tassels removed before pollination time and so its stigmas are necessarily pollinated by pollen from the male-designated line. The hybrid seeds are then harvested from the female line and so carry the microbes possessed by the female line, assuming that no microbes are transmitted via the pollen from the male parent. In this way the plant genes from the male line are brought into the genetic complement of the microbes of the female line.

The methods for the production of a uniform population of the seeds at a large scale can further comprise additional steps. For example, collected seeds can be further treated by any of the steps selected from hulling, cleaning, sorting, grading, and certifying. In one embodiment the commercial seeds are further processed to eliminate other crop seeds to less than 5% of total seeds, for example, no more than 4%, no more than 3%, no more than 2%, no more than 1%, no more than 0.5%, no more than 0.3%, or less of total seeds. In other cases, the commercial seed preparation is cleaned so that the preparation contains no more than 5% of inert matter, for example, no more than 4%, no more than 3%, no more than 2%, no more than 1%, no more than 0.5%, no more than 0.3%, or less of inert matter. In still another embodiment, the commercial seeds are tested to ensure that the seeds have a germination rate of at least 70%, for example, at least 75%, at least 80%, at least 85%, at least 90%, at least 95%, at least 97%, at least 98%, at least 99% or more.

The commercial seeds can be further treated. In one embodiment, the commercial seeds can be coated with a seed coating composition as described elsewhere.

Commodity Plant Product

In addition to scaling up the desired microbial preparation, the present invention provides an ability to harvest the plant 'bioreactors' to generate commodity plant products for commercial sale. This provides an additional means by which to reduce the total cost associated with the present invention's use of agricultural plants as bioreactors for microbial scale-up. As used herein, a "commodity plant product" refers to any composition or product that is comprised of material derived from a plant, seed, plant cell, or plant part of the present invention. Commodity plant products may be sold to consumers and can be viable or nonviable. Nonviable commodity products include but are not limited to nonviable seeds and grains; processed seeds, seed parts, and plant parts; dehydrated plant tissue, frozen plant tissue, and processed plant tissue; seeds and plant parts processed for animal feed for terrestrial and/or aquatic animal consumption, oil, meal, flour, flakes, bran, fiber, and any other food for human or animal consumption; and biomasses and fuel products. Any such commodity plant product that is derived from the plants of the present invention may contain at least a detectable amount of the specific and unique DNA corresponding to the microbes described herein. Any standard method of detection for polynucleotide molecules may be used, including methods of detection disclosed herein.

Utilizing Microbes Compatible with Agrichemicals

In certain embodiments, the microbe is selected on the basis of its compatibility with commonly used agrichemicals. As mentioned earlier, plants, particularly agricultural plants, can be treated with a vast array of agrichemicals, including fungicides, biocides (anti-bacterial agents), herbicides, insecticides, nematicides, rodenticides, fertilizers, and other agents.

In some cases, it can be important for the microbe to be compatible with agrichemicals, particularly those with fungicidal or antibacterial properties, in order to persist in the plant although, as mentioned earlier, there are many such fungicidal or antibacterial agents that do not penetrate the plant, at least at a concentration sufficient to interfere with the microbe. Therefore, where a systemic fungicide or antibacterial agent is used in the plant, compatibility of the microbe to be inoculated with such agents will be an important criterion.

In one embodiment, natural isolates of microbes which are compatible with agrichemicals can be used to inoculate the plants according to the methods described herein. For example, fungal microbes which are compatible with agriculturally employed fungicides can be isolated by plating a culture of the microbes on a petri dish containing an effective concentration of the fungicide, and isolating colonies of the microbe that are compatible with the fungicide. In another embodiment, a microbe that is compatible with a fungicide is used for the methods described herein. For example, the microbe is compatible with at least one of the fungicides listed on Table I. In another embodiment, the microbe is compatible with at least one of the fungicides listed on Table J. In still another embodiment, a microbe that is compatible with an antibacterial compound is used for the methods described herein. For example, the microbe is compatible with at least one of the antibiotics listed on Table G. Fungicide compatible microbes can also be isolated by selection on liquid medium. The culture of microbes can be plated on petri dishes without any forms of mutagenesis; alternatively, the microbes can be mutagenized using any means known in the art. For example, microbial cultures can be exposed to UV light, gamma-irradiation, or chemical mutagens such as ethylmethylsulfonate (EMS) prior to selection on fungicide containing media. Finally, where the mechanism of action of a particular fungicide is known, the target gene can be specifically mutated (either by gene deletion, gene replacement, site-directed mutagenesis, etc.) to generate a microbe that is resilient against that particular fungicide. It is noted that the above-described methods can be used to isolate *fungi* that are compatible with both fungistatic and fungicidal compounds.

It will also be appreciated by one skilled in the art that a plant may be exposed to multiple types of fungicides or antibacterial compounds, either simultaneously or in succession, for example at different stages of plant growth. Where the target plant is likely to be exposed to multiple fungicidal and/or antibacterial agents, a microbe that is compatible with many or all of these agrichemicals can be used to inoculate the plant. A microbe that is compatible with several fungicidal agents can be isolated, for example, by serial selection. A microbe that is compatible with the first fungicidal agent is isolated as described above (with or without prior mutagenesis). A culture of the resulting microbe can then be selected for the ability to grow on liquid or solid media containing the second antifungal compound (again, with or without prior mutagenesis). Colonies isolated from the second selection are then tested to confirm its compatibility to both antifungal compounds.

Likewise, bacterial microbes that are compatible to biocides (including herbicides such as glyphosate or antibacterial compounds, whether bacteriostatic or bactericidal) that are agriculturally employed can be isolated using methods similar to those described for isolating fungicide compatible microbes. In one embodiment, mutagenesis of the microbial population can be performed prior to selection with an antibacterial agent. In another embodiment, selection is performed on the microbial population without prior mutagenesis. In still another embodiment, serial selection is performed on a microbe: the microbe is first selected for compatibility to a first antibacterial agent. The isolated compatible microbe is then cultured and selected for compatibility to the second antibacterial agent. Any colony thus isolated is tested for compatibility to each, or both antibacterial agents to confirm compatibility with these two agents. The selection process described above can be repeated to identify isolates of the microbe that are compatible with a multitude of antifungal or antibacterial agents.

Candidate isolates can be tested to ensure that the selection for agrichemical compatibility did not result in loss of a desired microbial bioactivity. Isolates of the microbe that are compatible with commonly employed fungicides can be selected as described above. The resulting compatible microbe can be compared with the parental microbe on plants in its ability to promote germination.

Throughout the specification, the word "comprise," or variations such as "comprises" or "comprising," will be understood to imply the inclusion of a stated integer or group of integers but not the exclusion of any other integer or group of integers.

Although the present invention has been described in detail with reference to examples below, it is understood that various modifications can be made without departing from the spirit of the invention. Therefore, it will be appreciated that the scope of this invention is encompassed by the embodiments of the inventions recited herein and the specification rather than the specific examples that are exemplified below. All cited patents and publications referred to in this application are herein incorporated by reference in their entirety.

EXAMPLES

Example 1

Cultivation-Independent Analysis of Microbial Taxa in Agriculturally Relevant Seed Communities Based on Marker Gene High-Throughput Sequencing Example Description Microbial taxa core to agriculturally relevant communities were identified using high-throughput marker gene sequencing across several crops and numerous varieties of seeds. These microbes may be propagated or stored in a plant bioreactor.

Experimental Description

To identify core (i.e. ubiquitous) microbial taxa across seeds, high-throughput sequencing of marker genes for bacteria, archaea, and *fungi* was used. 50 commercial, 22 wild, and 33 landrace corn seeds, 40 commercial, 13 wild, and 23 landrace wheat seeds, 13 cotton seeds, and 24 soybean seeds were obtained. Non-commercial varieties were obtained from USDA GRIN through their National Plant Germplasm system (http://www.ars-grin.gov/npgs/). Accessions were categorized into landrace, wild, and inbred varieties based on the their assessment of improvement status. In order to extract microbial DNA, the seeds were first soaked in sterile, DNA-free water for 48 h to soften them, and they were surface sterilized using 95% ethanol to reduce superficial contaminant microbes. The seeds were then ground using a mortar and pestle treated with 95% ethanol and RNAse Away (Life Technologies, Inc., Grand Island, N.Y.) to remove contaminant DNA. DNA was extracted from the ground seeds using the PowerPlant Pro DNA extraction kit (Mo Bio Laboratories, Inc., Carlsbad, Calif.) according to the manufacturer's instructions.

Marker genes were amplified and sequenced from the extracted DNA using a high-throughput protocol similar to (Fierer et al. 2012, McGuire et al. 2013). For the bacterial and archaeal analyses, the V4 hypervariable region of the 16S rRNA gene was targeted (primers 515f/806r), and for *fungi*, the first internal transcribed spacer (ITS1) region of the rRNA operon (primers ITS1f/ITS2r) was targeted. The two marker genes were PCR amplified separately using 35 cycles, and error-correcting 12-bp barcoded primers specific to each sample were used to facilitate combining of samples. To reduce the amplification of chloroplast and mitochondrial DNA, we used PNA clamps specific to the rRNA genes in these organelles (Lundberg et al. 2013). PCR reactions to amplify 16S rRNA genes followed the protocol of (Lundberg et al. 2013), and those to amplify ITS regions followed the protocol of (Fierer et al. 2012). PCR products were quantified using the PicoGreen assay (Life Technologies, Inc., Grand Island, N.Y.), pooled in equimolar concentrations, and cleaned using the UltraClean kit (Mo Bio Laboratories, Inc., Carlsbad, Calif.). Cleaned DNA pools were sequenced on an Illumina MiSeq instrument at the University of Colorado Next Generation Sequencing Facility.

The raw sequence data were reassigned to distinct samples using a custom Python script, and quality filtering and OTU (operational taxonomic unit) clustering was conducted using the UPARSE pipeline (Edgar 2013). Briefly, a de novo sequence database with representative sequences for each OTU was created using a 97% similarity threshold, and raw reads were mapped to this database to calculate sequence counts per OTU per sample. Prior to creating the database, sequences were quality filtered using an expected error frequency threshold of 0.5 errors per sequence. In addition, sequences were dereplicated and singletons were removed prior to creating the database. OTUs were provided taxonomic classifications using the RDP classifier (Wang et al. 2007) trained with the Greengenes (McDonald et al. 2012) or UNITE (Abarenkov et al. 2010) databases for 16S rRNA and ITS sequences, respectively. To account for differences in the number of sequences per sample, each sample was rarefied to 1,000 and 6,500 sequences per sample for 16S rRNA and ITS datasets. This resulted in samples with fewer sequences than the rarefaction depth to be discarded from downstream analyses. OTUs classified as chloroplasts or mitochondria were discarded prior to rarefaction.

OTUs were determined to be core taxa based on detection across a variety of seed types. For example, taxa core across crops were those detected in >5% of seeds from each of the crops that were assessed. Similarly, taxa core to an individual crop were those detected in >5% of seeds from each of the cultivar categories (i.e. wild, landrace, inbred, or modern) within that crop. As additional quality control measures, OTUs where at least class level taxonomy could not be resolved and OTUs characteristic of soil or human skin (Dunn et al. 2013) were discarded. OTU counts from replicate samples of identical seed types were averaged prior to analysis.

Example Results

Among all of the OTUs we identified in this experiment, 192 were found to be core in corn, wheat, or across crops (Table 1). Among these, the 23 in Table 2 were found to be core across crops (Table 2).

TABLE 1

| SEQ ID NO. | OTU | Family | Genus | Species |
|---|---|---|---|---|
| 2227 | OTU_2152 | Actinosynnemataceae | Lentzea | |
| 2228 | OTU_90 | Actinosynnemataceae | | |
| 2229 | OTU_309 | Dermabacteraceae | Brachybacterium | |
| 2230 | OTU_2984 | Geodermatophilaceae | | |
| 2231 | OTU_132 | Glycomycetaceae | Glycomyces | |
| 2232 | OTU_1588 | Intrasporangiaceae | Phycicoccus | |
| 2233 | OTU_161 | Kineosporiaceae | | |
| 2234 | OTU_1207 | Kineosporiaceae | | |
| 2235 | OTU_28 | Microbacteriaceae | | |
| 2236 | OTU_302 | Microbacteriaceae | | |
| 2237 | OTU_3428 | Microbacteriaceae | | |
| 2238 | OTU_94 | Micrococcaceae | Arthrobacter | psychrolactophilus |
| 2239 | OTU_2968 | Micrococcaceae | Micrococcus | |
| 2240 | OTU_179 | Micrococcaceae | | |
| 2241 | OTU_200 | Micromonosporaceae | | |
| 2242 | OTU_350 | Mycobacteriaceae | Mycobacterium | |
| 2243 | OTU_100 | Nocardioidaceae | Aeromicrobium | |
| 2244 | OTU_3177 | Nocardioidaceae | Aeromicrobium | |
| 2245 | OTU_1142 | Nocardioidaceae | Kribbella | |
| 2246 | OTU_238 | Nocardioidaceae | Kribbella | |
| 2247 | OTU_730 | Nocardioidaceae | | |
| 2248 | OTU_992 | Nocardioidaceae | | |
| 2249 | OTU_392 | Promicromonosporaceae | Cellulosimicrobium | |
| 2250 | OTU_91 | Promicromonosporaceae | Promicromonospora | |
| 2251 | OTU_134 | Pseudonocardiaceae | Pseudonocardia | |
| 2252 | OTU_573 | Streptomycetaceae | Streptomyces | mirabilis |
| 2253 | OTU_3556 | Streptomycetaceae | Streptomyces | |
| 2254 | OTU_88 | Streptomycetaceae | | |
| 2255 | OTU_409 | Streptomycetaceae | | |
| 2256 | OTU_882 | | | |
| 2257 | OTU_713 | Gaiellaceae | | |
| 2258 | OTU_402 | Chitinophagaceae | Chitinophaga | |
| 2259 | OTU_3325 | Chitinophagaceae | Chitinophaga | |
| 2260 | OTU_218 | Chitinophagaceae | Lacibacter | cauensis |
| 2261 | OTU_57 | Chitinophagaceae | Sediminibacterium | |
| 2262 | OTU_213 | Chitinophagaceae | | |
| 2263 | OTU_362 | Chitinophagaceae | | |
| 2264 | OTU_348 | Chitinophagaceae | | |
| 2265 | OTU_208 | Chitinophagaceae | | |
| 2266 | OTU_237 | Chitinophagaceae | | |
| 2267 | OTU_163 | Cyclobacteriaceae | Algoriphagus | terrigena |
| 2268 | OTU_112 | Cytophagaceae | Dyadobacter | |
| 2269 | OTU_120 | Cytophagaceae | Dyadobacter | |
| 2270 | OTU_234 | Cytophagaceae | Emticicia | |
| 2271 | OTU_210 | Cytophagaceae | | |

TABLE 1-continued

| SEQ ID NO. | OTU | Family | Genus | Species |
|---|---|---|---|---|
| 2272 | OTU_187 | Cytophagaceae | | |
| 2273 | OTU_152 | Cytophagaceae | | |
| 2274 | OTU_1201 | Cytophagaceae | | |
| 2275 | OTU_287 | Cytophagaceae | | |
| 2276 | OTU_377 | Cytophagaceae | | |
| 2277 | OTU_2342 | Cytophagaceae | | |
| 2278 | OTU_487 | | | |
| 2279 | OTU_276 | Cryomorphaceae | *Fluviicola* | |
| 2280 | OTU_141 | Flavobacteriaceae | *Flavobacterium* | *columnare* |
| 2281 | OTU_148 | Flavobacteriaceae | *Flavobacterium* | *succinicans* |
| 2282 | OTU_3571 | Flavobacteriaceae | *Flavobacterium* | *succinicans* |
| 2283 | OTU_3528 | Flavobacteriaceae | *Flavobacterium* | |
| 2284 | OTU_67 | Sphingobacteriaceae | *Pedobacter* | |
| 2285 | OTU_109 | Sphingobacteriaceae | *Pedobacter* | |
| 2286 | OTU_3687 | Sphingobacteriaceae | | |
| 2287 | OTU_3184 | Sphingobacteriaceae | | |
| 2288 | OTU_3212 | Sphingobacteriaceae | | |
| 2289 | OTU_3301 | Sphingobacteriaceae | | |
| 2290 | OTU_86 | Sphingobacteriaceae | | |
| 2291 | OTU_406 | Sphingobacteriaceae | | |
| 2292 | OTU_129 | Sphingobacteriaceae | | |
| 2293 | OTU_2892 | Sphingobacteriaceae | | |
| 2294 | OTU_3722 | Sphingobacteriaceae | | |
| 2295 | OTU_191 | | | |
| 2296 | OTU_223 | Parachlamydiaceae | *Candidates* | *Protochlamydia* |
| 2297 | OTU_195 | | | |
| 2298 | OTU_790 | A4b | | |
| 2299 | OTU_103 | | | |
| 2300 | OTU_467 | Bacillaceae | *Bacillus* | *coagulans* |
| 2301 | OTU_3 | Bacillaceae | *Bacillus* | *firmus* |
| 2302 | OTU_27 | Bacillaceae | *Bacillus* | *flexus* |
| 2303 | OTU_3473 | Bacillaceae | *Bacillus* | |
| 2304 | OTU_131 | Bacillaceae | *Bacillus* | |
| 2305 | OTU_106 | Bacillaceae | *Geobacillus* | |
| 2306 | OTU_6 | Paenibacillaceae | *Paenibacillus* | |
| 2307 | OTU_38 | Planococcaceae | | |
| 2308 | OTU_763 | | | |
| 2309 | OTU_9 | Clostridiaceae | *Clostridium* | *butyricum* |
| 2310 | OTU_1079 | Clostridiaceae | SMB53 | |
| 2311 | OTU_181 | Clostridiaceae | *Thermoanaerobacterium* | *saccharolyticum* |
| 2312 | OTU_262 | Caldicellulosiruptoraceae | *Caldicellulosiruptor* | *saccharolyticus* |
| 2313 | OTU_431 | Carboxydocellaceae | *Carboxydocella* | |
| 2314 | OTU_158 | Caulobacteraceae | *Asticcacaulis* | *biprosthecium* |
| 2315 | OTU_340 | Caulobacteraceae | *Caulobacter* | |
| 2316 | OTU_157 | Caulobacteraceae | *Caulobacter* | |
| 2317 | OTU_243 | Caulobacteraceae | *Mycoplana* | |
| 2318 | OTU_292 | Caulobacteraceae | *Phenylobacterium* | |
| 2319 | OTU_341 | | | |
| 2320 | OTU_69 | Methylobacteriaceae | *Methylobacterium* | |
| 2321 | OTU_149 | Phyllobacteriaceae | *Mesorhizobium* | |
| 2322 | OTU_54 | Rhizobiaceae | *Agrobacterium* | |
| 2323 | OTU_3736 | Rhizobiaceae | *Agrobacterium* | |
| 2324 | OTU_174 | Rhizobiaceae | *Rhizobium* | |
| 2325 | OTU_3518 | Rhodospirillaceae | *Skermanella* | |
| 2326 | OTU_245 | Rhodospirillaceae | | |
| 2327 | OTU_289 | Rhodospirillaceae | | |
| 2328 | OTU_242 | | | |
| 2329 | OTU_185 | Erythrobacteraceae | | |
| 2330 | OTU_184 | Sphingomonadaceae | *Kaistobacter* | |
| 2331 | OTU_304 | Sphingomonadaceae | *Kaistobacter* | |
| 2332 | OTU_568 | Sphingomonadaceae | *Sphingomonas* | *echinoides* |
| 2333 | OTU_23 | Sphingomonadaceae | *Sphingomonas* | *yabuuchiae* |
| 2334 | OTU_3351 | Sphingomonadaceae | *Sphingomonas* | |
| 2335 | OTU_383 | Sphingomonadaceae | *Sphingomonas* | |
| 2336 | OTU_78 | Sphingomonadaceae | *Sphingomonas* | |
| 2337 | OTU_3439 | Sphingomonadaceae | *Sphingomonas* | |
| 2338 | OTU_93 | Sphingomonadaceae | *Sphingopyxis* | *alaskensis* |
| 2339 | OTU_199 | Alcaligenaceae | *Achromobacter* | |
| 2340 | OTU_18 | Burkholderiaceae | *Burkholderia* | |
| 2341 | OTU_639 | Burkholderiaceae | *Burkholderia* | |
| 2342 | OTU_2905 | Burkholderiaceae | *Burkholderia* | |
| 2343 | OTU_64 | Comamonadaceae | *Delftia* | |
| 2344 | OTU_283 | Comamonadaceae | *Hylemonella* | |
| 2345 | OTU_215 | Comamonadaceae | *Methylibium* | |
| 2346 | OTU_3641 | Comamonadaceae | *Polaromonas* | |
| 2347 | OTU_3253 | Comamonadaceae | *Variovorax* | *paradoxus* |
| 2348 | OTU_3420 | Comamonadaceae | *Variovorax* | |
| 2349 | OTU_236 | Comamonadaceae | | |

TABLE 1-continued

| SEQ ID NO. | OTU | Family | Genus | Species |
|---|---|---|---|---|
| 2350 | OTU_222 | Comamonadaceae | | |
| 2351 | OTU_2922 | Comamonadaceae | | |
| 2352 | OTU_3580 | Comamonadaceae | | |
| 2353 | OTU_443 | Comamonadaceae | | |
| 2354 | OTU_2585 | Comamonadaceae | | |
| 2355 | OTU_50 | Oxalobacteraceae | Herbaspirillum | |
| 2356 | OTU_3392 | Oxalobacteraceae | Janthinobacterium | lividum |
| 2357 | OTU_156 | Oxalobacteraceae | Janthinobacterium | |
| 2358 | OTU_3582 | Oxalobacteraceae | Janthinobacterium | |
| 2359 | OTU_315 | Oxalobacteraceae | Janthinobacterium | |
| 2360 | OTU_2266 | Oxalobacteraceae | Janthinobacterium | |
| 2361 | OTU_2954 | Oxalobacteraceae | Massilia | haematophila |
| 2362 | OTU_2344 | Oxalobacteraceae | Massilia | |
| 2363 | OTU_58 | Oxalobacteraceae | Ralstonia | |
| 2364 | OTU_15 | Oxalobacteraceae | | |
| 2365 | OTU_221 | Oxalobacteraceae | | |
| 2366 | OTU_2199 | Oxalobacteraceae | | |
| 2367 | OTU_1776 | | | |
| 2368 | OTU_507 | | | |
| 2369 | OTU_176 | Methylophilaceae | Methylotenera | mobilis |
| 2370 | OTU_115 | | | |
| 2371 | OTU_3227 | | | |
| 2372 | OTU_165 | Syntrophobacteraceae | | |
| 2373 | OTU_52 | Alteromonadaceae | Cellvibrio | |
| 2374 | OTU_146 | Alteromonadaceae | | |
| 2375 | OTU_1384 | Enterobacteriaceae | Enterobacter | hormaechei |
| 2376 | OTU_35 | Enterobacteriaceae | Enterobacter | |
| 2377 | OTU_2912 | Enterobacteriaceae | Erwinia | |
| 2378 | OTU_319 | Enterobacteriaceae | Escherichia | coli |
| 2379 | OTU_2 | Enterobacteriaceae | Pantoea | agglomerans |
| 2380 | OTU_1255 | Enterobacteriaceae | Pantoea | ananatis |
| 2381 | OTU_3489 | Enterobacteriaceae | Pantoea | |
| 2382 | OTU_2970 | Enterobacteriaceae | | |
| 2383 | OTU_3078 | Enterobacteriaceae | | |
| 2384 | OTU_3153 | Enterobacteriaceae | | |
| 2385 | OTU_145 | Coxiellaceae | Aquicella | |
| 2386 | OTU_379 | Coxiellaceae | Aquicella | |
| 2387 | OTU_390 | Coxiellaceae | Aquicella | |
| 2388 | OTU_209 | Coxiellaceae | Aquicella | |
| 2389 | OTU_197 | Coxiellaceae | | |
| 2390 | OTU_3292 | Pasteurellaceae | Haemophilus | parainfluenzae |
| 2391 | OTU_363 | Pasteurellaceae | Haemophilus | |
| 2392 | OTU_155 | Moraxellaceae | Acinetobacter | rhizosphaerae |
| 2393 | OTU_216 | Moraxellaceae | Acinetobacter | |
| 2394 | OTU_2544 | Pseudomonadaceae | Pseudomonas | viridiflava |
| 2395 | OTU_11 | Pseudomonadaceae | Pseudomonas | |
| 2396 | OTU_7 | Pseudomonadaceae | Pseudomonas | |
| 2397 | OTU_3276 | Pseudomonadaceae | Pseudomonas | |
| 2398 | OTU_3748 | Pseudomonadaceae | Pseudomonas | |
| 2399 | OTU_3228 | Pseudomonadaceae | Pseudomonas | |
| 2400 | OTU_204 | Pseudomonadaceae | Pseudomonas | |
| 2401 | OTU_2653 | Pseudomonadaceae | Pseudomonas | |
| 2402 | OTU_144 | Xanthomonadaceae | Arenimonas | |
| 2403 | OTU_3850 | Xanthomonadaceae | Dokdonella | |
| 2404 | OTU_177 | Xanthomonadaceae | Luteimonas | |
| 2405 | OTU_194 | Xanthomonadaceae | Lysobacter | |
| 2406 | OTU_527 | Xanthomonadaceae | Rhodanobacter | |
| 2407 | OTU_168 | Xanthomonadaceae | Rhodanobacter | |
| 2408 | OTU_83 | Xanthomonadaceae | Stenotrophomonas | |
| 2409 | OTU_2829 | Xanthomonadaceae | Stenotrophomonas | |
| 2410 | OTU_382 | Xanthomonadaceae | Xanthomonas | axonopodis |
| 2411 | OTU_334 | Leptospiraceae | Tumeriella | |
| 2412 | OTU_89 | Mycoplasmataceae | Mycoplasma | |
| 2413 | OTU_214 | auto67_4W | | |
| 2414 | OTU_385 | Opitutaceae | Opitutus | |
| 2415 | OTU_252 | Opitutaceae | Opitutus | |
| 2416 | OTU_279 | Opitutaceae | | |
| 2417 | OTU_280 | Verrucomicrobiaceae | Luteolibacter | |
| 2418 | OTU_172 | Verrucomicrobiaceae | Luteolibacter | |

TABLE 2

| #OTU ID | SEQ ID NO | Order | Family | Genus |
|---|---|---|---|---|
| OTU_28 | 2235 | Actinomycetales | Microbacteriaceae | |
| OTU_57 | 2261 | Saprospirales | Chitinophagaceae | *Sediminibacterium* |
| OTU_3473 | 2303 | Bacillales | Bacillaceae | *Bacillus* |
| OTU_131 | 2304 | Bacillales | Bacillaceae | *Bacillus* |
| OTU_38 | 2307 | Bacillales | Planococcaceae | |
| OTU_9 | 2309 | Clostridiales | Clostridiaceae | *Clostridium* |
| OTU_181 | 2311 | Clostridiales | Clostridiaceae | *Thermoanaerobacterium* |
| OTU_64 | 2343 | Burkholderiales | Comamonadaceae | *Delftia* |
| OTU_3392 | 2356 | Burkholderiales | Oxalobacteraceae | *Janthinobacterium* |
| OTU_2344 | 2362 | Burkholderiales | Oxalobacteraceae | *Massilia* |
| OTU_15 | 2364 | Burkholderiales | Oxalobacteraceae | |
| OTU_1384 | 2375 | Enterobacteriales | Enterobacteriaceae | *Enterobacter* |
| OTU_35 | 2376 | Enterobacteriales | Enterobacteriaceae | *Enterobacter* |
| OTU_2912 | 2377 | Enterobacteriales | Enterobacteriaceae | *Erwinia* |
| OTU_319 | 2378 | Enterobacteriales | Enterobacteriaceae | *Escherichia* |
| OTU_2 | 2379 | Enterobacteriales | Enterobacteriaceae | *Pantoea* |
| OTU_1255 | 2380 | Enterobacteriales | Enterobacteriaceae | *Pantoea* |
| OTU_3489 | 2381 | Enterobacteriales | Enterobacteriaceae | *Pantoea* |
| OTU_2970 | 2382 | Enterobacteriales | Enterobacteriaceae | |
| OTU_11 | 2395 | Pseudomonadales | Pseudomonadaceae | *Pseudomonas* |
| OTU_7 | 2396 | Pseudomonadales | Pseudomonadaceae | *Pseudomonas* |
| OTU_3276 | 2397 | Pseudomonadales | Pseudomonadaceae | *Pseudomonas* |
| OTU_83 | 2408 | Xanthomonadales | Xanthomonadaceae | *Stenotrophomonas* |

Example 2

Isolation of Bacterial Endophytes from Seeds, Seedlings, and Plants

Additional endophytic microbes that may be stored or propagated in the bioreactors of the present disclosure were isolated from seeds of commercially significant plants.

Diverse types of maize, wheat, rice, and other seeds were acquired and screened for cultivatable microbes. 49 distinct cultivars of maize and teosinte accessions were sourced from the USDA via GRIN (National Genetic Resources Program at http://www.ars-grin.gov/) or purchased from the Sustainable Seed Company (Covelo, Calif.). Similarly, 5 distinct wheat cultivars and wheat relatives were sourced from the USDA via GRIN (National Genetic Resources Program at http://www.ars-grin.gov/) or purchased from a Whole Foods in Cambridge, Mass. Seeds of rice and rice relatives (23 in total) were sourced from the USDA via GRIN (National Genetic Resources Program at http://www.ars-grin.gov/) or purchased from a Whole Foods in Cambridge, Mass. Seeds of several other species of plants, including sorghum, millet, oat, rye, teff, etc., were sourced from the USDA via GRIN (National Genetic Resources Program at the world wide web at ars-grin.gov/), the Sustainable Seed Company or purchased from a Whole Foods in Cambridge, Mass.

Pools of 5 seeds were soaked in 10 mL of sterile water contained in sterile 15 mL conical tubes for 24 hours. Some maize and rice accessions were sampled for seed surface microbes. In these cases, after 24 hours of soaking, 50 µL aliquots of undiluted, 100× dilute and 10000× dilute soaking water was plated onto R2A agar [Proteose peptone (0.5 g/L), Casamino acids (0.5 g/L), Yeast extract (0.5 g/L), Dextrose (0.5 g/L) Soluble starch (0.5 g/L), Dipotassium phosphate (0.3 g/L), Magnesium sulfate 7H$_2$O (0.05 g/L), Sodium pyruvate (0.3 g/L), Agar (15 g/L), Final pH 7±0.2 @ 25° C.] to culture oligotrophic bacteria, while the same volumes and dilutions were also plated onto potato dextrose agar (PDA) [Potato Infusion from 200 g/L, Dextrose 20 g/L, Agar 15 g/L, Final pH: 5.6±0.2 at 25° C.] to culture copiotrophic bacteria and *fungi*. All seeds in the study were sampled for endophytes by surface sterilization, trituration, and culturing of the mash. Seeds were surface sterilized by washing with 70% EtOH, rinsing with water, then washing with a 3% solution of sodium hypochlorite followed by 3 rinses in sterile water. All wash and rinse steps were 5 minutes with constant shaking at 130 rpm. Seeds were then blotted on R2A agar which was incubated at 30° C. for 7 days in order to confirm successful surface sterilization. Following the sterilization process, batches of seeds were ground with a sterile mortar and pestle in sterile R2A broth, while seeds of maize, rice and soy were also grown in sterile conditions and the roots or shoots of seedlings (without further sterilization) were crushed by bead beating in a Fastprep24 machine with 3 carbide beads, 1 mL of R2A broth in a 15 mL Falcon tube shaking at 6 M/s for 60 seconds. Extracts of surface washes, crushed seed, or macerated seedling tissue were serially diluted by factors of 1 to $10^{-3}$ and spread onto quadrants on R2A, PDA, LGI or V8 juice agar in order to isolate cultivable seed-borne microorganisms. Plates were incubated at 28° C. for 7 days, monitoring for the appearance of colonies daily. After a week, plates were photographed and different morphotypes of colonies were identified and labeled. These were then selected for identification by sequencing, backing up by freezing at −80° C. as glycerol stock, and assaying for beneficial functions as described herein.

Plating and Scoring of Microbes

After 7 days of growth, most bacterial colonies had grown large and distinct enough to allow differentiation based on colony size, shape, color and texture. Photographs of each plate were taken, and on the basis of color and morphotype, different colonies were identified by number for later reference. These strains were also streaked out onto either R2A or PDA to check for purity, and clean cultures were then scraped with a loop off the plate, resuspended in a mixture of R2A and glycerol, and frozen away in quadruplicate at −80° C. for later.

Example 3

Sequence Analysis & Phylogenetic Assignment

To accurately characterize the bacterial endophytes isolated in Example 2, colonies were submitted for marker gene sequencing, and the sequences were analyzed to provide taxonomic classifications. Colonies were subjected to 16S rRNA gene PCR amplification using a 27f/1492r primer set, and Sanger sequencing of paired ends was performed at Genewiz (South Plainfield, N.J.). Raw chromatograms were converted to sequences, and corresponding quality scores were assigned using TraceTuner v3.0.6beta (U.S. Pat. No. 6,681,186, incorporated herein by reference). These sequences were quality filtered using PRINSEQ v0.20.3 [Schmieder and Edwards (2011) Bioinformatics. 2011;27: 863-864, incorporated herein by reference] with left and right trim quality score thresholds of 30 and a quality window of 20 bp. Sequences without paired reads were discarded from further processing. Paired end quality filtered sequences were merged using USEARCH v7.0 [Edgar (2010) Nature methods 10:996-8]. Taxonomic classifications were assigned to the sequences using the RDP classifier [Wang et al., (2007) Applied and environmental microbiology 73:5261-7, incorporated herein by reference] trained on the Greengenes database [McDonald et al. (2012), ISME journal 6:610-8, incorporated herein by reference]. The resulting 473 microbes, representing 44 distinct OTUs (using a 97% similarity threshold) are provided in Table 3.

TABLE 3

Endophytic bacteria isolated from corn, rice and wheat seeds, including assignment to specific OTUs, corresponding Sequence ID numbers, Family, Genus, Taxonomic information and plant source from which the microbe was derived.

| Strain | OTU # | SEQ ID NO: | Seed-Origin Crop Type | Seed-Origin Cultivar Type | Source of seed-origin microbes | Family of Seed-Origin Microbe | Taxonomy of Seed-Origin Microbe |
|---|---|---|---|---|---|---|---|
| SYM00033 | 0 | 541 | Teosinte | Wild relative | Surface sterilized seeds | Enterobacteriaceae | *Enterobacter* sp. |
| SYM00173 | 0 | 593 | Rice | Modern | Surface sterilized seeds | Enterobacteriaceae | *Pantoea* sp. |
| SYM00176 | 0 | 596 | *Oryza nivara* | Wild relative | Surface sterilized seeds | Enterobacteriaceae | *Pantoea* sp. |
| SYM00284 | 0 | 633 | Maize | Modern | Surface sterilized seeds | Enterobacteriaceae | *Pantoea ananatis* |
| SYM00605 | 0 | 716 | Maize | Modern | Seed surface wash | Enterobacteriaceae | |
| SYM00607 | 0 | 717 | Maize | Modern | Seed surface wash | Enterobacteriaceae | |
| SYM00608 | 0 | 718 | Maize | Modern | Seed surface wash | Enterobacteriaceae | *Pantoea* sp. |
| SYM00620 | 0 | 720 | Teosinte | Wild relative | Seed surface wash | Enterobacteriaceae | *Enterobacter* sp. |
| SYM00658 | 0 | 736 | *Avena sterilis* | Wild relative | Seed surface wash | Enterobacteriaceae | |
| SYM00985 | 0 | 851 | Rice | Modern | Surface sterilized seeds | Enterobacteriaceae | |
| SYM01006 | 0 | 866 | Rice | Modern | Surface sterilized seeds | Enterobacteriaceae | |
| SYM01035 | 0 | 887 | *Avena sterilis* | Wild relative | Surface sterilized seeds | Enterobacteriaceae | |
| SYM01041 | 0 | 892 | Rice | Ancient Landrace | Surface sterilized seeds | Enterobacteriaceae | *Pantoea* sp. |
| SYM01158 | 0 | 937 | *Avena sterilis* | Wild relative | Roots & Seeds | Enterobacteriaceae | |
| SYM01173 | 0 | 943 | Rice | Ancient Landrace | Roots & Seeds | Enterobacteriaceae | |
| SYM01231 | 0 | 980 | Rice | Modern | Roots & Seeds | Enterobacteriaceae | |
| SYM00472 | 1 | 636 | Maize | Modern | Roots | Pseudomonadaceae | *Pseudomonas* sp. |
| SYM00660 | 1 | 737 | *Avena sterilis* | Wild relative | Seed surface wash | Pseudomonadaceae | *Pseudomonas* sp. |
| SYM00011 | 2 | 522 | Teosinte | Wild relative | Surface sterilized seeds | Pseudomonadaceae | *Pseudomonas* sp. |
| SYM00011b | 2 | 523 | Teosinte | Wild relative | Surface sterilized seeds | Pseudomonadaceae | *Pseudomonas* sp. |
| SYM00013 | 2 | 524 | Teosinte | Wild relative | Surface sterilized seeds | Pseudomonadaceae | *Pseudomonas* sp. |
| SYM00014 | 2 | 526 | Teosinte | Wild relative | Surface sterilized seeds | Pseudomonadaceae | *Pseudomonas* sp. |
| SYM00062 | 2 | 557 | Teosinte | Wild relative | Surface sterilized seeds | Pseudomonadaceae | *Pseudomonas* sp. |
| SYM00067 | 2 | 562 | Teosinte | Wild relative | Surface sterilized seeds | Pseudomonadaceae | *Pseudomonas* sp. |
| SYM00068 | 2 | 563 | Teosinte | Wild relative | Surface sterilized seeds | Pseudomonadaceae | *Pseudomonas* sp. |
| SYM00069 | 2 | 564 | Teosinte | Wild relative | Surface sterilized seeds | Pseudomonadaceae | *Pseudomonas* sp. |
| SYM00646 | 2 | 730 | Rice | Modern | Seed surface wash | Pseudomonadaceae | *Pseudomonas* sp. |
| SYM00649 | 2 | 733 | Rice | Modern | Seed surface wash | Pseudomonadaceae | *Pseudomonas* sp. |
| SYM00650 | 2 | 734 | Rice | Modern | Seed surface wash | Pseudomonadaceae | *Pseudomonas* sp. |
| SYM00657 | 2 | 735 | *Avena sterilis* | Wild relative | Seed surface wash | Pseudomonadaceae | *Pseudomonas* sp. |
| SYM00672 | 2 | 738 | *Oryza latifolia* | Wild relative | Seed surface wash | Pseudomonadaceae | *Pseudomonas* sp. |
| SYM00709 | 2 | 747 | Rice | Modern | Seed surface wash | Pseudomonadaceae | *Pseudomonas* sp. |
| SYM00926 | 2 | 804 | Rice | Ancient Landrace | Surface sterilized seeds | Pseudomonadaceae | *Pseudomonas* sp. |
| SYM00927 | 2 | 805 | Rice | Ancient Landrace | Surface sterilized seeds | Pseudomonadaceae | *Pseudomonas* sp. |
| SYM00946 | 2 | 821 | Rice | Modern | Surface sterilized seeds | Pseudomonadaceae | *Pseudomonas* sp. |
| SYM00955 | 2 | 828 | Rice | Ancient Landrace | Surface sterilized seeds | Pseudomonadaceae | *Pseudomonas* sp. |
| SYM00970 | 2 | 839 | Rice | Ancient Landrace | Surface sterilized seeds | Pseudomonadaceae | *Pseudomonas* sp. |
| SYM00971 | 2 | 840 | Rice | Ancient Landrace | Surface sterilized seeds | Pseudomonadaceae | *Pseudomonas* sp. |
| SYM00973 | 2 | 842 | Rice | Ancient Landrace | Surface sterilized seeds | Pseudomonadaceae | *Pseudomonas* sp. |
| SYM00993 | 2 | 857 | *Oryza officinalis* | Wild relative | Surface sterilized seeds | Pseudomonadaceae | *Pseudomonas* sp. |
| SYM01007 | 2 | 867 | Rice | Modern | Surface sterilized seeds | Pseudomonadaceae | *Pseudomonas* sp. |
| SYM01024 | 2 | 880 | *Oryza nivara* | Wild relative | Surface sterilized seeds | Pseudomonadaceae | *Pseudomonas* sp. |
| SYM01032 | 2 | 885 | *Avena sterilis* | Wild relative | Surface sterilized seeds | Pseudomonadaceae | *Pseudomonas* sp. |
| SYM01036 | 2 | 888 | Rice | Modern | Surface sterilized seeds | Pseudomonadaceae | *Pseudomonas* sp. |
| SYM01164 | 2 | 940 | Rice | Ancient Landrace | Roots & Seeds | Pseudomonadaceae | *Pseudomonas* sp. |
| SYM01171 | 2 | 942 | Rice | Ancient Landrace | Roots & Seeds | Pseudomonadaceae | *Pseudomonas* sp. |
| SYM01177 | 2 | 947 | Rice | Ancient Landrace | Roots & Seeds | Pseudomonadaceae | *Pseudomonas* sp. |
| SYM01178 | 2 | 948 | Rice | Ancient Landrace | Roots & Seeds | Pseudomonadaceae | *Pseudomonas* sp. |
| SYM01225 | 2 | 975 | Rice | Modern | Roots & Seeds | Pseudomonadaceae | *Pseudomonas* sp. |
| SYM01245 | 2 | 988 | Rice | Ancient Landrace | Roots & Seeds | Pseudomonadaceae | *Pseudomonas* sp. |
| SYM01251 | 2 | 989 | Rice | Ancient Landrace | Roots & Seeds | Pseudomonadaceae | *Pseudomonas* sp. |
| SYM01254 | 2 | 990 | Rice | Ancient Landrace | Roots & Seeds | Pseudomonadaceae | *Pseudomonas* sp. |
| SYM00013b | 3 | 525 | Teosinte | Wild relative | Surface sterilized seeds | Microbacteriaceae | *Curtobacterium* sp. |
| SYM00167 | 3 | 588 | Rice | Modern | Surface sterilized seeds | Microbacteriaceae | *Curtobacterium* sp. |
| SYM00171 | 3 | 591 | Rice | Modern | Surface sterilized seeds | Microbacteriaceae | *Curtobacterium* sp. |
| SYM00174 | 3 | 594 | Rye | Modern | Surface sterilized seeds | Microbacteriaceae | *Curtobacterium* sp. |
| SYM00178 | 3 | 598 | Rice | Ancient Landrace | Surface sterilized seeds | Microbacteriaceae | *Curtobacterium* sp. |

TABLE 3-continued

Endophytic bacteria isolated from corn, rice and wheat seeds, including assignment to specific OTUs, corresponding Sequence ID numbers, Family, Genus, Taxonomic information and plant source from which the microbe was derived.

| Strain | OTU # | SEQ ID NO: | Seed-Origin Crop Type | Seed-Origin Cultivar Type | Source of seed-origin microbes | Family of Seed-Origin Microbe | Taxonomy of Seed-Origin Microbe |
|---|---|---|---|---|---|---|---|
| SYM00180 | 3 | 600 | Rice | Ancient Landrace | Surface sterilized seeds | Microbacteriaceae | Curtobacterium sp. |
| SYM00181 | 3 | 601 | Rice | Ancient Landrace | Surface sterilized seeds | Microbacteriaceae | Curtobacterium sp. |
| SYM00235 | 3 | 622 | Rice | Modern | Surface sterilized seeds | Microbacteriaceae | Curtobacterium sp. |
| SYM00244 | 3 | 626 | Barley | Modern | Surface sterilized seeds | Microbacteriaceae | Curtobacterium sp. |
| SYM00525 | 3 | 654 | Oryza nivara | Wild relative | Seed surface wash | Microbacteriaceae | Curtobacterium sp. |
| SYM00625 | 3 | 724 | Maize | Modern | Seed surface wash | Microbacteriaceae | Curtobacterium sp. |
| SYM00645 | 3 | 729 | Rice | Modern | Seed surface wash | Microbacteriaceae | Curtobacterium sp. |
| SYM00647 | 3 | 731 | Rice | Modern | Seed surface wash | Microbacteriaceae | Curtobacterium sp. |
| SYM00673b | 3 | 739 | Oryza latifolia | Wild relative | Seed surface wash | Microbacteriaceae | Curtobacterium sp. |
| SYM00690 | 3 | 740 | Rice | Modern | Seed surface wash | Microbacteriaceae | Curtobacterium sp. |
| SYM00691 | 3 | 741 | Rice | Modern | Seed surface wash | Microbacteriaceae | Curtobacterium sp. |
| SYM00693 | 3 | 742 | Rice | Modern | Seed surface wash | Microbacteriaceae | Curtobacterium sp. |
| SYM00694b | 3 | 744 | Rice | Modern | Seed surface wash | Microbacteriaceae | Curtobacterium sp. |
| SYM00712 | 3 | 748 | Rice | Modern | Seed surface wash | Microbacteriaceae | Curtobacterium sp. |
| SYM00716 | 3 | 752 | Rice | Ancient Landrace | Seed surface wash | Microbacteriaceae | Curtobacterium sp. |
| SYM00722 | 3 | 753 | Rice | Ancient Landrace | Seed surface wash | Microbacteriaceae | Curtobacterium sp. |
| SYM00722B | 3 | 754 | Rice | Ancient Landrace | Seed surface wash | Microbacteriaceae | Curtobacterium sp. |
| SYM00731B | 3 | 756 | Rice | Ancient Landrace | Seed surface wash | Microbacteriaceae | Curtobacterium sp. |
| SYM00749 | 3 | 758 | Rice | Ancient Landrace | Surface sterilized seeds | Microbacteriaceae | Curtobacterium sp. |
| SYM00784 | 3 | 773 | Maize | Modern | Seed surface wash | Microbacteriaceae | Curtobacterium sp. |
| SYM00947 | 3 | 822 | Rice | Modern | Surface sterilized seeds | Microbacteriaceae | Curtobacterium sp. |
| SYM00949 | 3 | 823 | Rice | Modern | Surface sterilized seeds | Microbacteriaceae | Curtobacterium sp. |
| SYM00952 | 3 | 826 | Rice | Ancient Landrace | Surface sterilized seeds | Microbacteriaceae | Curtobacterium sp. |
| SYM00964 | 3 | 834 | Rice | Ancient Landrace | Surface sterilized seeds | Microbacteriaceae | Curtobacterium sp. |
| SYM00976 | 3 | 844 | Rice | Ancient Landrace | Surface sterilized seeds | Microbacteriaceae | Curtobacterium sp. |
| SYM00980 | 3 | 847 | Rice | Modern | Surface sterilized seeds | Microbacteriaceae | Curtobacterium sp. |
| SYM00984 | 3 | 850 | Rice | Modern | Surface sterilized seeds | Microbacteriaceae | Curtobacterium sp. |
| SYM00996 | 3 | 859 | Oryza officinalis | Wild relative | Surface sterilized seeds | Microbacteriaceae | Curtobacterium sp. |
| SYM01013 | 3 | 872 | Rice | Ancient Landrace | Surface sterilized seeds | Microbacteriaceae | Curtobacterium sp. |
| SYM01022 | 3 | 879 | Oryza nivara | Wild relative | Surface sterilized seeds | Microbacteriaceae | Curtobacterium sp. |
| SYM01025 | 3 | 881 | Oryza nivara | Wild relative | Surface sterilized seeds | Microbacteriaceae | Curtobacterium sp. |
| SYM01142 | 3 | 928 | Rice | Modern | Roots & Seeds | Microbacteriaceae | Curtobacterium sp. |
| SYM01144 | 3 | 929 | Rice | Modern | Roots & Seeds | Microbacteriaceae | Curtobacterium sp. |
| SYM01148 | 3 | 931 | Rice | Modern | Roots & Seeds | Microbacteriaceae | Curtobacterium sp. |
| SYM01151 | 3 | 932 | Rice | Modern | Roots & Seeds | Microbacteriaceae | Curtobacterium sp. |
| SYM01155 | 3 | 935 | Rice | Modern | Roots & Seeds | Microbacteriaceae | Curtobacterium sp. |
| SYM01156 | 3 | 936 | Rice | Modern | Roots & Seeds | Microbacteriaceae | Curtobacterium sp. |
| SYM01179 | 3 | 949 | Rice | Modern | Roots & Seeds | Microbacteriaceae | Curtobacterium sp. |
| SYM01181 | 3 | 951 | Rice | Modern | Roots & Seeds | Microbacteriaceae | Curtobacterium sp. |
| SYM01182 | 3 | 952 | Rice | Modern | Roots & Seeds | Microbacteriaceae | Curtobacterium sp. |
| SYM01183 | 3 | 953 | Rice | Modern | Roots & Seeds | Microbacteriaceae | Curtobacterium sp. |
| SYM01184 | 3 | 954 | Rice | Modern | Roots & Seeds | Microbacteriaceae | Curtobacterium sp. |
| SYM01185 | 3 | 955 | Rice | Modern | Roots & Seeds | Microbacteriaceae | Curtobacterium sp. |
| SYM01188 | 3 | 957 | Rice | Modern | Roots & Seeds | Microbacteriaceae | Curtobacterium sp. |
| SYM01198 | 3 | 962 | Rice | Modern | Roots & Seeds | Microbacteriaceae | Curtobacterium sp. |
| SYM01199 | 3 | 963 | Rice | Modern | Roots & Seeds | Microbacteriaceae | Curtobacterium sp. |
| SYM01201 | 3 | 964 | Rice | Modern | Roots & Seeds | Microbacteriaceae | Curtobacterium sp. |
| SYM01202 | 3 | 965 | Rice | Modern | Roots & Seeds | Microbacteriaceae | Curtobacterium sp. |
| SYM01204 | 3 | 966 | Rice | Modern | Roots & Seeds | Microbacteriaceae | Curtobacterium sp. |
| SYM01205 | 3 | 967 | Rice | Modern | Roots & Seeds | Microbacteriaceae | Curtobacterium sp. |
| SYM01207 | 3 | 969 | Rice | Modern | Roots & Seeds | Microbacteriaceae | Curtobacterium sp. |
| SYM01215 | 3 | 971 | Rice | Modern | Roots & Seeds | Microbacteriaceae | Curtobacterium sp. |
| SYM01218 | 3 | 973 | Rice | Modern | Roots & Seeds | Microbacteriaceae | Curtobacterium sp. |
| SYM01222 | 3 | 974 | Rice | Modern | Roots & Seeds | Microbacteriaceae | Curtobacterium sp. |
| SYM00188 | 6 | 605 | Maize | Modern | Leaves | Paenibacillaceae | Paenibacillus sp. |
| SYM00190 | 6 | 607 | Maize | Modern | Leaves | Paenibacillaceae | Paenibacillus sp. |
| SYM00195 | 6 | 610 | Maize | Modern | Leaves | Paenibacillaceae | Paenibacillus sp. |
| SYM00217 | 6 | 616 | Soybean | Modern | Roots | Paenibacillaceae | Paenibacillus sp. |
| SYM00227 | 6 | 619 | Soybean | Modern | Leaves | Paenibacillaceae | Paenibacillus sp. |
| SYM00292 | 6 | 634 | Maize | Modern | Surface sterilized seeds | Paenibacillaceae | Paenibacillus taichungensis |
| SYM00597 | 6 | 711 | Maize | Ancient Landrace | Seed surface wash | Paenibacillaceae | Paenibacillus sp. |
| SYM01108 | 6 | 915 | Oryza nivara | Wild relative | Surface sterilized seeds | Paenibacillaceae | Paenibacillus sp. |
| SYM01109 | 6 | 916 | Oryza nivara | Wild relative | Surface sterilized seeds | Paenibacillaceae | Paenibacillus sp. |
| SYM01110 | 6 | 917 | Oryza nivara | Wild relative | Surface sterilized seeds | Paenibacillaceae | Paenibacillus sp. |
| SYM01111 | 6 | 918 | Oryza nivara | Wild relative | Surface sterilized seeds | Paenibacillaceae | Paenibacillus sp. |
| SYM01112 | 6 | 919 | Oryza nivara | Wild relative | Surface sterilized seeds | Paenibacillaceae | Paenibacillus sp. |
| SYM01114 | 6 | 921 | Maize | Modern | Roots | Paenibacillaceae | Paenibacillus sp. |
| SYM01117 | 6 | 922 | Maize | Ancient Landrace | Roots | Paenibacillaceae | Paenibacillus sp. |
| SYM01118 | 6 | 923 | Maize | Ancient Landrace | Roots | Paenibacillaceae | Paenibacillus sp. |
| SYM01127 | 6 | 925 | Teosinte | Wild relative | Roots | Paenibacillaceae | Paenibacillus sp. |
| SYM01256 | 6 | 991 | Maize | Ancient Landrace | Roots | Paenibacillaceae | Paenibacillus sp. |
| SYM00014b | 7 | 527 | Teosinte | Wild relative | Surface sterilized seeds | Enterobacteriaceae | Erwinia sp. |

TABLE 3-continued

Endophytic bacteria isolated from corn, rice and wheat seeds, including assignment to specific OTUs, corresponding Sequence ID numbers, Family, Genus, Taxonomic information and plant source from which the microbe was derived.

| Strain | OTU # | SEQ ID NO: | Seed-Origin Crop Type | Seed-Origin Cultivar Type | Source of seed-origin microbes | Family of Seed-Origin Microbe | Taxonomy of Seed-Origin Microbe |
| --- | --- | --- | --- | --- | --- | --- | --- |
| SYM00017b | 7 | 532 | Rice | Modern | Surface sterilized seeds | Enterobacteriaceae | *Pantoea* sp. |
| SYM00018 | 7 | 534 | Maize | Ancient Landrace | Surface sterilized seeds | Enterobacteriaceae | *Pantoea* sp. |
| SYM00020 | 7 | 535 | Maize | Ancient Landrace | Surface sterilized seeds | Enterobacteriaceae | *Pantoea* sp. |
| SYM00022 | 7 | 537 | Teosinte | Wild relative | Surface sterilized seeds | Enterobacteriaceae | *Pantoea* sp. |
| SYM00025 | 7 | 538 | Maize | Ancient Landrace | Surface sterilized seeds | Enterobacteriaceae | *Pantoea* sp. |
| SYM00026 | 7 | 539 | Maize | Ancient Landrace | Surface sterilized seeds | Enterobacteriaceae | *Pantoea* sp. |
| SYM00043 | 7 | 544 | Maize | Modern | Surface sterilized seeds | Enterobacteriaceae | *Pantoea* sp. |
| SYM00047 | 7 | 546 | Maize | Ancient Landrace | Surface sterilized seeds | Enterobacteriaceae | *Pantoea* sp. |
| SYM00049 | 7 | 547 | Maize | Ancient Landrace | Surface sterilized seeds | Enterobacteriaceae | *Pantoea* sp. |
| SYM00055 | 7 | 553 | Maize | Ancient Landrace | Surface sterilized seeds | Enterobacteriaceae | *Pantoea* sp. |
| SYM00057 | 7 | 554 | Maize | Ancient Landrace | Surface sterilized seeds | Enterobacteriaceae | *Pantoea* sp. |
| SYM00058 | 7 | 555 | Maize | Ancient Landrace | Surface sterilized seeds | Enterobacteriaceae | *Pantoea* sp. |
| SYM00078 | 7 | 568 | Maize | Ancient Landrace | Surface sterilized seeds | Enterobacteriaceae | *Pantoea* sp. |
| SYM00081 | 7 | 569 | Maize | Ancient Landrace | Seed surface wash | Enterobacteriaceae | *Pantoea* sp. |
| SYM00082a | 7 | 570 | Maize | Ancient Landrace | Seed surface wash | Enterobacteriaceae | *Pantoea* sp. |
| SYM00085 | 7 | 571 | Maize | Modern | Surface sterilized seeds | Enterobacteriaceae | *Pantoea* sp. |
| SYM00086 | 7 | 572 | Maize | Modern | Surface sterilized seeds | Enterobacteriaceae | *Pantoea* sp. |
| SYM00087 | 7 | 573 | Maize | Maize PI 485356 | Surface sterilized seeds | Enterobacteriaceae | *Pantoea* sp. |
| SYM00088 | 7 | 574 | Maize | Maize PI 485356 | Surface sterilized seeds | Enterobacteriaceae | *Pantoea* sp. |
| SYM00094 | 7 | 576 | Maize | Ancient Landrace | Surface sterilized seeds | Enterobacteriaceae | *Pantoea* sp. |
| SYM00095 | 7 | 577 | Maize | Ancient Landrace | Surface sterilized seeds | Enterobacteriaceae | *Pantoea* sp. |
| SYM00096 | 7 | 578 | Maize | Ancient Landrace | Surface sterilized seeds | Enterobacteriaceae | *Pantoea* sp. |
| SYM00100 | 7 | 579 | Maize | Ancient Landrace | Surface sterilized seeds | Enterobacteriaceae | *Pantoea* sp. |
| SYM00101 | 7 | 580 | Maize | Ancient Landrace | Surface sterilized seeds | Enterobacteriaceae | *Pantoea* sp. |
| SYM00502 | 7 | 639 | Maize | Ancient Landrace | Seed surface wash | Enterobacteriaceae | *Erwinia* sp. |
| SYM00506 | 7 | 641 | Maize | Ancient Landrace | Seed surface wash | Enterobacteriaceae | *Erwinia* sp. |
| SYM00506b | 7 | 642 | Maize | Ancient Landrace | Seed surface wash | Enterobacteriaceae | *Erwinia* sp. |
| SYM00511 | 7 | 647 | Maize | Ancient Landrace | Seed surface wash | Enterobacteriaceae | *Erwinia* sp. |
| SYM00514b | 7 | 649 | Maize | Ancient Landrace | Seed surface wash | Enterobacteriaceae | *Erwinia* sp. |
| SYM00514C | 7 | 650 | Maize | Ancient Landrace | Seed surface wash | Enterobacteriaceae | *Erwinia* sp. |
| SYM00514D | 7 | 651 | Maize | Ancient Landrace | Seed surface wash | Enterobacteriaceae | *Erwinia* sp. |
| SYM00731A | 7 | 755 | Rice | Ancient Landrace | Seed surface wash | Enterobacteriaceae | *Erwinia* sp. |
| SYM00785 | 7 | 774 | Maize | Modern | Seed surface wash | Enterobacteriaceae | *Erwinia* sp. |
| SYM01056 | 7 | 903 | Teosinte | Wild relative | Surface sterilized seeds | Enterobacteriaceae | *Erwinia* sp. |
| SYM01235 | 7 | 984 | *Oryza officinalis* | Wild relative | Roots & Seeds | Enterobacteriaceae | *Erwinia* sp. |
| SYM01238 | 7 | 986 | *Oryza officinalis* | Wild relative | Roots & Seeds | Enterobacteriaceae | *Erwinia* sp. |
| SYM00967 | 8 | 837 | Rice | Ancient Landrace | Surface sterilized seeds | Methylobacteriaceae | |
| SYM01233 | 8 | 982 | *Oryza officinalis* | Wild relative | Roots & Seeds | Methylobacteriaceae | |
| SYM00544 | 9 | 663 | Maize | Ancient Landrace | Seed surface wash | Brucellaceae | *Ochrobactrum* sp. |
| SYM00545B | 9 | 665 | Maize | Ancient Landrace | Seed surface wash | Brucellaceae | *Ochrobactrum* sp. |
| SYM00548 | 9 | 667 | Maize | Ancient Landrace | Seed surface wash | Brucellaceae | *Ochrobactrum* sp. |
| SYM00552 | 9 | 670 | Maize | Ancient Landrace | Seed surface wash | Brucellaceae | *Ochrobactrum* sp. |
| SYM00558 | 9 | 675 | Maize | Ancient Landrace | Seed surface wash | Brucellaceae | *Ochrobactrum* sp. |
| SYM00580A | 9 | 688 | Maize | Modern | Seed surface wash | Brucellaceae | *Ochrobactrum* sp. |
| SYM00580b | 9 | 689 | Maize | Modern | Seed surface wash | Brucellaceae | *Ochrobactrum* sp. |
| SYM00580d | 9 | 691 | Maize | Modern | Seed surface wash | Brucellaceae | *Ochrobactrum* sp. |
| SYM00581d | 9 | 698 | Maize | Modern | Seed surface wash | Brucellaceae | *Ochrobactrum* sp. |
| SYM00583 | 9 | 699 | Maize | Ancient Landrace | Seed surface wash | Brucellaceae | *Ochrobactrum* sp. |
| SYM00584 | 9 | 700 | Maize | Ancient Landrace | Seed surface wash | Brucellaceae | *Ochrobactrum* sp. |
| SYM00588 | 9 | 705 | Maize | Ancient Landrace | Seed surface wash | Brucellaceae | *Ochrobactrum* sp. |
| SYM00596 | 9 | 710 | Maize | Ancient Landrace | Seed surface wash | Brucellaceae | *Ochrobactrum* sp. |
| SYM00600 | 9 | 713 | Maize | Ancient Landrace | Seed surface wash | Brucellaceae | *Ochrobactrum* sp. |
| SYM00746 | 9 | 757 | Rice | Ancient Landrace | Surface sterilized seeds | Brucellaceae | *Ochrobactrum* sp. |
| SYM00752 | 9 | 759 | Maize | Modern | Seed surface wash | Brucellaceae | *Ochrobactrum* sp. |
| SYM00756 | 9 | 761 | Maize | Modern | Seed surface wash | Brucellaceae | *Ochrobactrum* sp. |
| SYM00763 | 9 | 767 | Maize | Modern | Seed surface wash | Brucellaceae | *Ochrobactrum* sp. |
| SYM00783 | 9 | 772 | Maize | Modern | Seed surface wash | Brucellaceae | *Ochrobactrum* sp. |
| SYM00812 | 9 | 775 | Rice | Modern | Seed surface wash | Brucellaceae | *Ochrobactrum* sp. |
| SYM00902 | 9 | 783 | Maize | Ancient Landrace | Surface sterilized seeds | Brucellaceae | *Ochrobactrum* sp. |
| SYM00923 | 9 | 802 | Maize | Modern | Surface sterilized seeds | Brucellaceae | *Ochrobactrum* sp. |
| SYM00935 | 9 | 810 | Rice | Modern | Surface sterilized seeds | Brucellaceae | *Ochrobactrum* sp. |
| SYM00937 | 9 | 812 | Rice | Modern | Surface sterilized seeds | Brucellaceae | *Ochrobactrum* sp. |
| SYM00954 | 9 | 827 | Rice | Ancient Landrace | Surface sterilized seeds | Brucellaceae | *Ochrobactrum* sp. |
| SYM01029 | 9 | 883 | *Avena sterilis* | Wild relative | Surface sterilized seeds | Brucellaceae | *Ochrobactrum* sp. |
| SYM01043 | 9 | 894 | Rice | Modern | Surface sterilized seeds | Brucellaceae | *Ochrobactrum* sp. |
| SYM01047 | 9 | 896 | *Oryza latifolia* | Wild relative | Surface sterilized seeds | Brucellaceae | *Ochrobactrum* sp. |
| SYM01052 | 9 | 899 | Maize | Ancient Landrace | Surface sterilized seeds | Brucellaceae | *Ochrobactrum* sp. |
| SYM01054 | 9 | 901 | Maize | Ancient Landrace | Surface sterilized seeds | Brucellaceae | *Ochrobactrum* sp. |
| SYM01055 | 9 | 902 | Maize | Ancient Landrace | Surface sterilized seeds | Brucellaceae | *Ochrobactrum* sp. |
| SYM01058 | 9 | 904 | Maize | Ancient Landrace | Surface sterilized seeds | Brucellaceae | *Ochrobactrum* sp. |
| SYM01064 | 9 | 906 | Maize | Ancient Landrace | Surface sterilized seeds | Brucellaceae | *Ochrobactrum* sp. |
| SYM01066 | 9 | 908 | Maize | Ancient Landrace | Surface sterilized seeds | Brucellaceae | *Ochrobactrum* sp. |
| SYM01069 | 9 | 909 | Maize | Modern | Surface sterilized seeds | Brucellaceae | *Ochrobactrum* sp. |

TABLE 3-continued

Endophytic bacteria isolated from corn, rice and wheat seeds, including assignment to specific OTUs, corresponding Sequence
ID numbers, Family, Genus, Taxonomic information and plant source from which the microbe was derived.

| Strain | OTU # | SEQ ID NO: | Seed-Origin Crop Type | Seed-Origin Cultivar Type | Source of seed-origin microbes | Family of Seed-Origin Microbe | Taxonomy of Seed-Origin Microbe |
|---|---|---|---|---|---|---|---|
| SYM01079 | 9 | 913 | Maize | Modern | Surface sterilized seeds | Brucellaceae | *Ochrobactrum* sp. |
| SYM00064a | 10 | 560 | Teosinte | Wild relative | Surface sterilized seeds | Xanthomonadaceae | *Stenotrophomonas* sp. |
| SYM00183 | 10 | 603 | *Oryza glumipatula* | Wild relative | Surface sterilized seeds | Xanthomonadaceae | *Stenotrophomonas* sp. |
| SYM00184 | 10 | 604 | *Oryza glumipatula* | Wild relative | Surface sterilized seeds | Xanthomonadaceae | *Stenotrophomonas* sp. |
| SYM00905 | 10 | 786 | Maize | Modern | Surface sterilized seeds | Xanthomonadaceae | *Stenotrophomonas* sp. |
| SYM00543 | 12 | 662 | Maize | Ancient Landrace | Seed surface wash | Bacillaceae | *Bacillus* sp. |
| SYM00595 | 12 | 709 | Maize | Ancient Landrace | Seed surface wash | Bacillaceae | *Bacillus* sp. |
| SYM01227 | 12 | 977 | Rice | Modern | Roots & Seeds | Bacillaceae | *Bacillus* sp. |
| SYM00547 | 13 | 666 | Maize | Ancient Landrace | Seed surface wash | Alcaligenaceae | *Achromobacter* sp. |
| SYM00551 | 13 | 669 | Maize | Ancient Landrace | Seed surface wash | Alcaligenaceae | *Achromobacter* sp. |
| SYM00560 | 13 | 676 | Maize | Ancient Landrace | Seed surface wash | Alcaligenaceae | *Achromobacter* sp. |
| SYM00565B | 13 | 681 | Maize | Modern | Seed surface wash | Alcaligenaceae | *Achromobacter* sp. |
| SYM00580C | 13 | 690 | Maize | Modern | Seed surface wash | Alcaligenaceae | *Achromobacter* sp. |
| SYM00580i | 13 | 694 | Maize | Modern | Seed surface wash | Alcaligenaceae | *Achromobacter* sp. |
| SYM00585 | 13 | 701 | Maize | Ancient Landrace | Seed surface wash | Alcaligenaceae | *Achromobacter* sp. |
| SYM00586b | 13 | 702 | Maize | Ancient Landrace | Seed surface wash | Alcaligenaceae | *Achromobacter* sp. |
| SYM00588b | 13 | 706 | Maize | Ancient Landrace | Seed surface wash | Alcaligenaceae | *Achromobacter* sp. |
| SYM00591 | 13 | 708 | Maize | Ancient Landrace | Seed surface wash | Alcaligenaceae | *Achromobacter* sp. |
| SYM00602 | 13 | 715 | Maize | Modern | Seed surface wash | Alcaligenaceae | *Achromobacter* sp. |
| SYM00758 | 13 | 763 | Maize | Modern | Seed surface wash | Alcaligenaceae | *Achromobacter* sp. |
| SYM00761 | 13 | 765 | Maize | Modern | Seed surface wash | Alcaligenaceae | *Achromobacter* sp. |
| SYM00764 | 13 | 768 | Maize | Modern | Seed surface wash | Alcaligenaceae | *Achromobacter* sp. |
| SYM00765 | 13 | 769 | Maize | Modern | Seed surface wash | Alcaligenaceae | *Achromobacter* sp. |
| SYM00824 | 13 | 777 | Rice | Ancient Landrace | Seed surface wash | Alcaligenaceae | *Achromobacter* sp. |
| SYM00828 | 13 | 778 | Rice | Ancient Landrace | Seed surface wash | Alcaligenaceae | *Achromobacter* sp. |
| SYM00830 | 13 | 779 | Rice | Ancient Landrace | Seed surface wash | Alcaligenaceae | *Achromobacter* sp. |
| SYM00831 | 13 | 780 | Rice | Ancient Landrace | Seed surface wash | Alcaligenaceae | *Achromobacter* sp. |
| SYM00901 | 13 | 782 | Maize | Ancient Landrace | Surface sterilized seeds | Alcaligenaceae | *Achromobacter* sp. |
| SYM00903 | 13 | 784 | Maize | Modern | Surface sterilized seeds | Alcaligenaceae | *Achromobacter* sp. |
| SYM00904 | 13 | 785 | Maize | Modern | Surface sterilized seeds | Alcaligenaceae | *Achromobacter* sp. |
| SYM00907 | 13 | 787 | Maize | Modern | Surface sterilized seeds | Alcaligenaceae | *Achromobacter* sp. |
| SYM00908 | 13 | 788 | Maize | Ancient Landrace | Surface sterilized seeds | Alcaligenaceae | *Achromobacter* sp. |
| SYM00909 | 13 | 789 | Maize | Ancient Landrace | Surface sterilized seeds | Alcaligenaceae | *Achromobacter* sp. |
| SYM00910 | 13 | 790 | Maize | Modern | Surface sterilized seeds | Alcaligenaceae | *Achromobacter* sp. |
| SYM00914 | 13 | 794 | Maize | Modern | Surface sterilized seeds | Alcaligenaceae | *Achromobacter* sp. |
| SYM00917 | 13 | 796 | Maize | Modern | Surface sterilized seeds | Alcaligenaceae | *Achromobacter* sp. |
| SYM00929 | 13 | 806 | *Oryza latifolia* | Wild relative | Surface sterilized seeds | Alcaligenaceae | *Achromobacter* sp. |
| SYM00930 | 13 | 807 | Rice | Modern | Surface sterilized seeds | Alcaligenaceae | *Achromobacter* sp. |
| SYM00938 | 13 | 813 | Rice | Modern | Surface sterilized seeds | Alcaligenaceae | *Achromobacter* sp. |
| SYM00957 | 13 | 829 | Rice | Ancient Landrace | Surface sterilized seeds | Alcaligenaceae | *Achromobacter* sp. |
| SYM00959 | 13 | 830 | Rice | Ancient Landrace | Surface sterilized seeds | Alcaligenaceae | *Achromobacter* sp. |
| SYM01017 | 13 | 875 | Rice | Modern | Surface sterilized seeds | Alcaligenaceae | *Achromobacter* sp. |
| SYM01020 | 13 | 877 | Rice | Modern | Surface sterilized seeds | Alcaligenaceae | *Achromobacter* sp. |
| SYM01021 | 13 | 878 | *Oryza nivara* | Wild relative | Surface sterilized seeds | Alcaligenaceae | *Achromobacter* sp. |
| SYM01030 | 13 | 884 | *Avena sterilis* | Wild relative | Surface sterilized seeds | Alcaligenaceae | *Achromobacter* sp. |
| SYM00028 | 18 | 540 | Maize | Ancient Landrace | Surface sterilized seeds | Enterobacteriaceae | *Enterobacter* sp. |
| SYM00052 | 18 | 550 | Teosinte | Wild relative | Surface sterilized seeds | Enterobacteriaceae | *Enterobacter* sp. |
| SYM00053 | 18 | 551 | Teosinte | Wild relative | Surface sterilized seeds | Enterobacteriaceae | *Enterobacter* sp. |
| SYM00054 | 18 | 552 | Teosinte | Wild relative | Surface sterilized seeds | Enterobacteriaceae | *Enterobacter* sp. |
| SYM00175 | 18 | 595 | Winter rye | Modern | Surface sterilized seeds | Enterobacteriaceae | *Enterobacter* sp. |
| SYM00627 | 18 | 725 | Maize | Modern | Seed surface wash | Enterobacteriaceae | *Enterobacter* sp. |
| SYM00715 | 18 | 751 | Rice | Modern | Seed surface wash | Enterobacteriaceae | *Enterobacter* sp. |
| SYM00189 | 19 | 606 | Maize | Modern | Leaves | Bacillaceae | *Bacillus* sp. |
| SYM00192 | 19 | 608 | Maize | Modern | Leaves | Bacillaceae | *Bacillus* sp. |
| SYM00197 | 19 | 611 | Maize | Modern | Leaves | Bacillaceae | *Bacillus* sp. |
| SYM00201 | 19 | 612 | Maize | Maize | Roots | Bacillaceae | *Bacillus* sp. |
| SYM00202 | 19 | 613 | Maize | Maize | Roots | Bacillaceae | *Bacillus* sp. |
| SYM00215 | 19 | 615 | Soybean | Modern | Roots | Bacillaceae | *Bacillus* sp. |
| SYM00233 | 19 | 621 | Soybean | Modern | Leaves | Bacillaceae | *Bacillus* sp. |
| SYM00260 | 19 | 632 | Maize | Modern | Surface sterilized seeds | Bacillaceae | *Bacillus simplex* |
| SYM01113 | 19 | 920 | Maize | Modern | Roots | Bacillaceae | *Bacillus* sp. |
| SYM01119 | 19 | 924 | Maize | Ancient Landrace | Roots | Bacillaceae | *Bacillus* sp. |
| SYM00016b | 25 | 529 | Rice | Modern | Surface sterilized seeds | Methylobacteriaceae | *Methylobacterium* sp. |
| SYM00236 | 25 | 623 | Rice | Modern | Surface sterilized seeds | Methylobacteriaceae | *Methylobacterium* sp. |
| SYM00237 | 25 | 624 | Rice | Modern | Surface sterilized seeds | Methylobacteriaceae | *Methylobacterium* sp. |
| SYM00240 | 25 | 625 | Rice | Modern | Surface sterilized seeds | Methylobacteriaceae | *Methylobacterium* sp. |
| SYM00924 | 25 | 803 | Rice | Ancient Landrace | Surface sterilized seeds | Methylobacteriaceae | *Methylobacterium* sp. |
| SYM00936 | 25 | 811 | Rice | Modern | Surface sterilized seeds | Methylobacteriaceae | *Methylobacterium* sp. |
| SYM00950 | 25 | 824 | Rice | Ancient Landrace | Surface sterilized seeds | Methylobacteriaceae | *Methylobacterium* sp. |
| SYM00968 | 25 | 838 | Rice | Ancient Landrace | Surface sterilized seeds | Methylobacteriaceae | *Methylobacterium* sp. |
| SYM00986 | 25 | 852 | Rice | Modern | Surface sterilized seeds | Methylobacteriaceae | *Methylobacterium* sp. |
| SYM00998 | 25 | 861 | *Oryza officinalis* | Wild relative | Surface sterilized seeds | Methylobacteriaceae | *Methylobacterium* sp. |
| SYM00999 | 25 | 862 | *Oryza officinalis* | Wild relative | Surface sterilized seeds | Methylobacteriaceae | *Methylobacterium* sp. |

TABLE 3-continued

Endophytic bacteria isolated from corn, rice and wheat seeds, including assignment to specific OTUs, corresponding Sequence ID numbers, Family, Genus, Taxonomic information and plant source from which the microbe was derived.

| Strain | OTU # | SEQ ID NO: | Seed-Origin Crop Type | Seed-Origin Cultivar Type | Source of seed-origin microbes | Family of Seed-Origin Microbe | Taxonomy of Seed-Origin Microbe |
|---|---|---|---|---|---|---|---|
| SYM01003 | 25 | 864 | Rice | Modern | Surface sterilized seeds | Methylobacteriaceae | *Methylobacterium* sp. |
| SYM01008 | 25 | 868 | Rice | Modern | Surface sterilized seeds | Methylobacteriaceae | *Methylobacterium* sp. |
| SYM00501 | 27 | 638 | Maize | Ancient Landrace | Seed surface wash | Burkholderiaceae | *Burkholderia* sp. |
| SYM00504 | 27 | 640 | Maize | Ancient Landrace | Seed surface wash | Burkholderiaceae | *Burkholderia* sp. |
| SYM00536 | 27 | 656 | Maize | Ancient Landrace | Seed surface wash | Burkholderiaceae | *Burkholderia* sp. |
| SYM00536A | 27 | 657 | Maize | Ancient Landrace | Seed surface wash | Burkholderiaceae | *Burkholderia* sp. |
| SYM00538E | 27 | 659 | Maize | Ancient Landrace | Seed surface wash | Burkholderiaceae | *Burkholderia* sp. |
| SYM00566A | 27 | 682 | Maize | Modern | Seed surface wash | Burkholderiaceae | *Burkholderia* sp. |
| SYM00568 | 27 | 683 | Maize | Modern | Seed surface wash | Burkholderiaceae | *Burkholderia* sp. |
| SYM00570 | 27 | 684 | Maize | Modern | Seed surface wash | Burkholderiaceae | *Burkholderia* sp. |
| SYM00574 | 27 | 685 | Maize | Ancient Landrace | Seed surface wash | Burkholderiaceae | *Burkholderia* sp. |
| SYM00575 | 27 | 686 | Maize | Ancient Landrace | Seed surface wash | Burkholderiaceae | *Burkholderia* sp. |
| SYM00578 | 27 | 687 | Maize | Modern | Seed surface wash | Burkholderiaceae | *Burkholderia* sp. |
| SYM00621 | 27 | 721 | Maize | Modern | Seed surface wash | Burkholderiaceae | *Burkholderia* sp. |
| SYM00623 | 27 | 722 | Maize | Modern | Seed surface wash | Burkholderiaceae | *Burkholderia* sp. |
| SYM00624 | 27 | 723 | Maize | Modern | Seed surface wash | Burkholderiaceae | *Burkholderia* sp. |
| SYM00633 | 27 | 727 | Maize | Ancient Landrace | Seed surface wash | Burkholderiaceae | *Burkholderia* sp. |
| SYM00822 | 27 | 776 | Rice | Modern | Seed surface wash | Burkholderiaceae | *Burkholderia* sp. |
| SYM01010 | 27 | 869 | Rice | Ancient Landrace | Surface sterilized seeds | Burkholderiaceae | *Burkholderia* sp. |
| SYM01012 | 27 | 871 | Rice | Ancient Landrace | Surface sterilized seeds | Burkholderiaceae | *Burkholderia* sp. |
| SYM01015 | 27 | 873 | Rice | Ancient Landrace | Surface sterilized seeds | Burkholderiaceae | *Burkholderia* sp. |
| SYM01037 | 27 | 889 | Rice | Modern | Surface sterilized seeds | Burkholderiaceae | *Burkholderia* sp. |
| SYM00037 | 28 | 543 | Maize | Modern | Surface sterilized seeds | Microbacteriaceae | *Bacillus* sp. |
| SYM00051 | 28 | 549 | Teosinte | Wild relative | Surface sterilized seeds | Microbacteriaceae | *Microbacterium* sp. |
| SYM00104 | 28 | 582 | Maize | Ancient Landrace | Surface sterilized seeds | Microbacteriaceae | *Microbacterium* sp. |
| SYM00177 | 28 | 597 | *Oryza nivara* | Wild relative | Surface sterilized seeds | Microbacteriaceae | *Microbacterium* sp. |
| SYM00514A | 28 | 648 | Maize | Ancient Landrace | Seed surface wash | Microbacteriaceae | *Microbacterium* sp. |
| SYM00523 | 28 | 652 | *Oryza nivara* | Wild relative | Seed surface wash | Microbacteriaceae | *Microbacterium* sp. |
| SYM00538H | 28 | 660 | Maize | Ancient Landrace | Seed surface wash | Microbacteriaceae | *Microbacterium* sp. |
| SYM00542 | 28 | 661 | Maize | Ancient Landrace | Seed surface wash | Microbacteriaceae | *Microbacterium* sp. |
| SYM00556 | 28 | 674 | Maize | Ancient Landrace | Seed surface wash | Microbacteriaceae | *Microbacterium* sp. |
| SYM00581A | 28 | 695 | Maize | Modern | Seed surface wash | Microbacteriaceae | *Microbacterium* sp. |
| SYM00586c | 28 | 703 | Maize | Ancient Landrace | Seed surface wash | Microbacteriaceae | *Microbacterium* sp. |
| SYM00587 | 28 | 704 | Maize | Ancient Landrace | Seed surface wash | Microbacteriaceae | *Microbacterium* sp. |
| SYM00598 | 28 | 712 | Maize | Ancient Landrace | Seed surface wash | Microbacteriaceae | *Microbacterium* sp. |
| SYM00757 | 28 | 762 | Maize | Modern | Seed surface wash | Microbacteriaceae | *Microbacterium* sp. |
| SYM00760 | 28 | 764 | Maize | Modern | Seed surface wash | Microbacteriaceae | *Microbacterium* sp. |
| SYM00780 | 28 | 771 | Maize | Modern | Seed surface wash | Microbacteriaceae | *Microbacterium* sp. |
| SYM00832 | 28 | 781 | Rice | Ancient Landrace | Seed surface wash | Microbacteriaceae | *Microbacterium* sp. |
| SYM00911 | 28 | 791 | Maize | Modern | Surface sterilized seeds | Microbacteriaceae | *Microbacterium* sp. |
| SYM00912 | 28 | 792 | Maize | Ancient Landrace | Surface sterilized seeds | Microbacteriaceae | *Microbacterium* sp. |
| SYM00913 | 28 | 793 | Maize | Ancient Landrace | Surface sterilized seeds | Microbacteriaceae | *Microbacterium* sp. |
| SYM00915 | 28 | 795 | Maize | Modern | Surface sterilized seeds | Microbacteriaceae | *Microbacterium* sp. |
| SYM00918 | 28 | 797 | Maize | Ancient Landrace | Surface sterilized seeds | Microbacteriaceae | *Microbacterium* sp. |
| SYM00919 | 28 | 798 | Maize | Ancient Landrace | Surface sterilized seeds | Microbacteriaceae | *Microbacterium* sp. |
| SYM00920 | 28 | 799 | Maize | Ancient Landrace | Surface sterilized seeds | Microbacteriaceae | *Microbacterium* sp. |
| SYM00921 | 28 | 800 | Maize | Modern | Surface sterilized seeds | Microbacteriaceae | *Microbacterium* sp. |
| SYM00922 | 28 | 801 | Maize | Modern | Surface sterilized seeds | Microbacteriaceae | *Microbacterium* sp. |
| SYM00931 | 28 | 808 | Rice | Modern | Surface sterilized seeds | Microbacteriaceae | *Microbacterium* sp. |
| SYM00933 | 28 | 809 | Rice | Modern | Surface sterilized seeds | Microbacteriaceae | *Microbacterium* sp. |
| SYM00939 | 28 | 814 | Rice | Modern | Surface sterilized seeds | Microbacteriaceae | *Microbacterium* sp. |
| SYM00944 | 28 | 819 | Rice | Modern | Surface sterilized seeds | Microbacteriaceae | *Microbacterium* sp. |
| SYM00962 | 28 | 832 | Rice | Ancient Landrace | Surface sterilized seeds | Microbacteriaceae | *Microbacterium* sp. |
| SYM01000 | 28 | 863 | *Oryza officinalis* | Wild relative | Surface sterilized seeds | Microbacteriaceae | *Microbacterium* sp. |
| SYM01034 | 28 | 886 | *Avena sterilis* | Wild relative | Surface sterilized seeds | Microbacteriaceae | *Microbacterium* sp. |
| SYM01206 | 28 | 968 | Rice | Modern | Roots & Seeds | Microbacteriaceae | *Microbacterium* sp. |
| SYM00015 | 29 | 528 | Rice | Modern | Surface sterilized seeds | Xanthomonadaceae | *Xanthomonas* sp. |
| SYM00021 | 29 | 536 | Teosinte | Wild relative | Surface sterilized seeds | Xanthomonadaceae | *Xanthomonas* sp. |
| SYM00179 | 29 | 599 | Rice | Ancient Landrace | Surface sterilized seeds | Xanthomonadaceae | *Xanthomonas* sp. |
| SYM00182 | 29 | 602 | Rice | Ancient Landrace | Surface sterilized seeds | Xanthomonadaceae | *Xanthomonas* sp. |
| SYM00252 | 29 | 630 | Rice | Ancient Landrace | Surface sterilized seeds | Xanthomonadaceae | *Xanthomonas* sp. |
| SYM00977 | 29 | 845 | Rice | Ancient Landrace | Surface sterilized seeds | Xanthomonadaceae | *Xanthomonas* sp. |
| SYM00988 | 29 | 854 | Rice | Modern | Surface sterilized seeds | Xanthomonadaceae | *Xanthomonas* sp. |
| SYM00997 | 29 | 860 | *Oryza officinalis* | Wild relative | Surface sterilized seeds | Xanthomonadaceae | *Xanthomonas* sp. |
| SYM01018 | 29 | 876 | Rice | Modern | Surface sterilized seeds | Xanthomonadaceae | *Xanthomonas* sp. |
| SYM01028 | 29 | 882 | *Oryza nivara* | Wild relative | Surface sterilized seeds | Xanthomonadaceae | *Xanthomonas* sp. |
| SYM01146 | 29 | 930 | Rice | Modern | Roots & Seeds | Xanthomonadaceae | *Xanthomonas* sp. |
| SYM01153 | 29 | 933 | Rice | Modern | Roots & Seeds | Xanthomonadaceae | *Xanthomonas* sp. |
| SYM01154 | 29 | 934 | Rice | Modern | Roots & Seeds | Xanthomonadaceae | *Xanthomonas* sp. |
| SYM01162 | 29 | 939 | Rice | Ancient Landrace | Roots & Seeds | Xanthomonadaceae | *Xanthomonas* sp. |
| SYM01190 | 29 | 959 | Rice | Modern | Roots & Seeds | Xanthomonadaceae | *Xanthomonas* sp. |
| SYM00565A | 30 | 680 | Maize | Modern | Seed surface wash | Nocardiaceae | *Rhodococcus* sp. |
| SYM00580G | 30 | 693 | Maize | Modern | Seed surface wash | Nocardiaceae | *Rhodococcus* sp. |

TABLE 3-continued

Endophytic bacteria isolated from corn, rice and wheat seeds, including assignment to specific OTUs, corresponding Sequence ID numbers, Family, Genus, Taxonomic information and plant source from which the microbe was derived.

| Strain | OTU # | SEQ ID NO: | Seed-Origin Crop Type | Seed-Origin Cultivar Type | Source of seed-origin microbes | Family of Seed-Origin Microbe | Taxonomy of Seed-Origin Microbe |
|---|---|---|---|---|---|---|---|
| SYM00753 | 30 | 760 | Maize | Modern | Seed surface wash | Nocardiaceae | *Rhodococcus* sp. |
| SYM00762 | 30 | 766 | Maize | Modern | Seed surface wash | Nocardiaceae | *Rhodococcus* sp. |
| SYM00775 | 30 | 770 | Maize | Modern | Seed surface wash | Nocardiaceae | *Rhodococcus* sp. |
| SYM00943 | 30 | 818 | Rice | Modern | Surface sterilized seeds | Nocardiaceae | *Rhodococcus* sp. |
| SYM00951 | 30 | 825 | Rice | Ancient Landrace | Surface sterilized seeds | Nocardiaceae | *Rhodococcus* sp. |
| SYM01039 | 30 | 890 | Rice | Ancient Landrace | Surface sterilized seeds | Nocardiaceae | *Rhodococcus* sp. |
| SYM01040 | 30 | 891 | Rice | Ancient Landrace | Surface sterilized seeds | Nocardiaceae | *Rhodococcus* sp. |
| SYM01042 | 30 | 893 | Rice | Modern | Surface sterilized seeds | Nocardiaceae | *Rhodococcus* sp. |
| SYM01046 | 30 | 895 | Rice | Modern | Surface sterilized seeds | Nocardiaceae | *Rhodococcus* sp. |
| SYM01048 | 30 | 897 | *Oryza latifolia* | Wild relative | Surface sterilized seeds | Nocardiaceae | *Rhodococcus* sp. |
| SYM01053 | 30 | 900 | Maize | Modern | Surface sterilized seeds | Nocardiaceae | *Rhodococcus* sp. |
| SYM01063 | 30 | 905 | Maize | Modern | Surface sterilized seeds | Nocardiaceae | *Rhodococcus* sp. |
| SYM01065 | 30 | 907 | Maize | Ancient Landrace | Surface sterilized seeds | Nocardiaceae | *Rhodococcus* sp. |
| SYM01070 | 30 | 910 | Rice | Modern | Surface sterilized seeds | Nocardiaceae | *Rhodococcus* sp. |
| SYM01071 | 30 | 911 | Maize | Ancient Landrace | Surface sterilized seeds | Nocardiaceae | *Rhodococcus* sp. |
| SYM01078 | 30 | 912 | Rice | Modern | Surface sterilized seeds | Nocardiaceae | *Rhodococcus* sp. |
| SYM00589 | 31 | 707 | Maize | Ancient Landrace | Seed surface wash | Paenibacillaceae | *Paenibacillus* sp. |
| SYM00991 | 36 | 855 | Rice | Modern | Surface sterilized seeds | Comamonadaceae | *Acidovorax* sp. |
| SYM01236 | 36 | 985 | *Oryza officinalis* | Wild relative | Roots & Seeds | Comamonadaceae | *Acidovorax* sp. |
| SYM00057B | 37 | 1446 | Maize | Ancient Landrace | Surface sterilized seeds | Burkholderiaceae | *Burkholderia phytofirmans* |
| SYM00102 | 38 | 581 | Maize | Ancient Landrace | Surface sterilized seeds | Staphylococcaceae | *Staphylococcus* sp. |
| SYM00072 | 39 | 566 | Teosinte | Wild relative | Surface sterilized seeds | Bacillaceae | *Bacillus* sp. |
| SYM00075 | 39 | 567 | Teosinte | Wild relative | Surface sterilized seeds | Bacillaceae | *Bacillus* sp. |
| SYM00249 | 39 | 628 | Soybean | Modern | Surface sterilized seeds | Bacillaceae | *Bacillus* sp. |
| SYM00507 | 39 | 645 | Maize | Ancient Landrace | Seed surface wash | Bacillaceae | *Bacillus* sp. |
| SYM00553 | 39 | 671 | Maize | Ancient Landrace | Seed surface wash | Bacillaceae | *Bacillus* sp. |
| SYM00562 | 39 | 677 | Maize | Ancient Landrace | Seed surface wash | Bacillaceae | *Bacillus* sp. |
| SYM00564 | 39 | 679 | Maize | Ancient Landrace | Seed surface wash | Bacillaceae | *Bacillus* sp. |
| SYM00580E | 39 | 692 | Maize | Modern | Seed surface wash | Bacillaceae | *Bacillus* sp. |
| SYM00581b | 39 | 696 | Maize | Modern | Seed surface wash | Bacillaceae | *Bacillus* sp. |
| SYM00581c | 39 | 697 | Maize | Modern | Seed surface wash | Bacillaceae | *Bacillus* sp. |
| SYM00601 | 39 | 714 | Maize | Ancient Landrace | Seed surface wash | Bacillaceae | *Bacillus* sp. |
| SYM00036 | 41 | 542 | Maize | Modern | Surface sterilized seeds | Bacillaceae | *Bacillus* sp. |
| SYM00110 | 41 | 586 | Maize | Modern | Surface sterilized seeds | Bacillaceae | *Bacillus* sp. |
| SYM00193 | 41 | 609 | Maize | Modern | Leaves | Bacillaceae | *Bacillus* sp. |
| SYM00218 | 41 | 617 | Soybean | Modern | Roots | Bacillaceae | *Bacillus* sp. |
| SYM00250 | 41 | 629 | Soybean | Modern | Surface sterilized seeds | Bacillaceae | *Bacillus* sp. |
| SYM00697 | 41 | 745 | Rice | Modern | Seed surface wash | Bacillaceae | *Bacillus* sp. |
| SYM00704 | 41 | 746 | Rice | Modern | Seed surface wash | Bacillaceae | *Bacillus* sp. |
| SYM00017c | 45 | 533 | Rice | Modern | Surface sterilized seeds | Sphingomonadaceae | *Sphingomonas* sp. |
| SYM00062b | 45 | 558 | Teosinte | Wild relative | Surface sterilized seeds | Sphingomonadaceae | *Sphingomonas* sp. |
| SYM00065 | 45 | 561 | Teosinte | Wild relative | Surface sterilized seeds | Sphingomonadaceae | *Sphingomonas* sp. |
| SYM00168 | 45 | 589 | Rice | Modern | Surface sterilized seeds | Sphingomonadaceae | *Sphingomonas* sp. |
| SYM00169 | 45 | 590 | Rice | Modern | Surface sterilized seeds | Sphingomonadaceae | *Sphingomonas* sp. |
| SYM00942 | 45 | 817 | Rice | Modern | Surface sterilized seeds | Sphingomonadaceae | *Sphingomonas* sp. |
| SYM00994 | 45 | 858 | *Oryza officinalis* | Wild relative | Surface sterilized seeds | Sphingomonadaceae | *Sphingomonas* sp. |
| SYM01016 | 45 | 874 | Rice | Modern | Surface sterilized seeds | Sphingomonadaceae | *Sphingomonas* sp. |
| SYM01174 | 45 | 944 | Rice | Ancient Landrace | Roots & Seeds | Sphingomonadaceae | *Sphingomonas* sp. |
| SYM01176 | 45 | 946 | Rice | Ancient Landrace | Roots & Seeds | Sphingomonadaceae | *Sphingomonas* sp. |
| SYM01187 | 45 | 956 | Rice | Modern | Roots & Seeds | Sphingomonadaceae | *Sphingomonas* sp. |
| SYM01191 | 45 | 960 | Rice | Modern | Roots & Seeds | Sphingomonadaceae | *Sphingomonas* sp. |
| SYM01214 | 45 | 970 | Rice | Modern | Roots & Seeds | Sphingomonadaceae | *Sphingomonas* sp. |
| SYM01216 | 45 | 972 | Rice | Modern | Roots & Seeds | Sphingomonadaceae | *Sphingomonas* sp. |
| SYM00231 | 46 | 620 | Soybean | Modern | Leaves | Sphingomonadaceae | *Sphingobium* sp. |
| SYM00975 | 51 | 843 | Rice | Ancient Landrace | Surface sterilized seeds | Oxalobacteraceae | *Herbaspirillum* sp. |
| SYM00506c | 53 | 643 | Maize | Ancient Landrace | Seed surface wash | Paenibacillaceae | *Paenibacillus* sp. |
| SYM00506D | 53 | 644 | Maize | Ancient Landrace | Seed surface wash | Paenibacillaceae | *Paenibacillus* sp. |
| SYM00545 | 53 | 664 | Maize | Ancient Landrace | Seed surface wash | Paenibacillaceae | *Paenibacillus* sp. |
| SYM00549 | 53 | 668 | Maize | Ancient Landrace | Seed surface wash | Paenibacillaceae | *Paenibacillus* sp. |
| SYM00554 | 53 | 672 | Maize | Ancient Landrace | Seed surface wash | Paenibacillaceae | *Paenibacillus* sp. |
| SYM00555 | 53 | 673 | Maize | Ancient Landrace | Seed surface wash | Paenibacillaceae | *Paenibacillus* sp. |
| SYM00012 | 55 | 1447 | Teosinte | Wild relative | Surface sterilized seeds | Microbacteriaceae | *Microbacterium binotii* |
| SYM00046 | 56 | 545 | Maize | Ancient Landrace | Surface sterilized seeds | Enterobacteriaceae | *Enterobacter* sp. |
| SYM00050 | 56 | 548 | Maize | Ancient Landrace | Surface sterilized seeds | Enterobacteriaceae | *Enterobacter* sp. |
| SYM00628 | 56 | 726 | Maize | Modern | Seed surface wash | Enterobacteriaceae | *Enterobacter* sp. |
| SYM01049 | 56 | 898 | Teosinte | Wild relative | Surface sterilized seeds | Enterobacteriaceae | |
| SYM00106 | 59 | 583 | Maize | Ancient Landrace | Surface sterilized seeds | Micrococcaceae | *Micrococcus* sp. |
| SYM00107 | 59 | 584 | Maize | Ancient Landrace | Surface sterilized seeds | Micrococcaceae | *Micrococcus* sp. |
| SYM00108 | 59 | 585 | Maize | Ancient Landrace | Surface sterilized seeds | Micrococcaceae | *Micrococcus* sp. |
| SYM00254 | 59 | 631 | Maize | Modern | Surface sterilized seeds | Micrococcaceae | *Micrococcus* sp. |
| SYM00090 | 62 | 575 | Maize | Ancient Landrace | Surface sterilized seeds | Flavobacteriaceae | *Chryseobacterium* sp. |
| SYM00002 | 66 | 521 | Teosinte | Wild relative | Surface sterilized seeds | Rhizobiaceae | *Agrobacterium* sp. |

TABLE 3-continued

Endophytic bacteria isolated from corn, rice and wheat seeds, including assignment to specific OTUs, corresponding Sequence ID numbers, Family, Genus, Taxonomic information and plant source from which the microbe was derived.

| Strain | OTU # | SEQ ID NO: | Seed-Origin Crop Type | Seed-Origin Cultivar Type | Source of seed-origin microbes | Family of Seed-Origin Microbe | Taxonomy of Seed-Origin Microbe |
|---|---|---|---|---|---|---|---|
| SYM00017a | 66 | 531 | Rice | Modern | Surface sterilized seeds | Rhizobiaceae | *Agrobacterium* sp. |
| SYM00326 | 66 | 635 | Maize | Modern | Roots | Rhizobiaceae | *Agrobacterium tumefaciens* |
| SYM00714 | 66 | 750 | Rice | Modern | Seed surface wash | Rhizobiaceae | *Agrobacterium* sp. |
| SYM00983 | 66 | 849 | Rice | Modern | Surface sterilized seeds | Rhizobiaceae | *Agrobacterium* sp. |
| SYM01004 | 66 | 865 | Rice | Modern | Surface sterilized seeds | Rhizobiaceae | *Agrobacterium* sp. |
| SYM00060 | 67 | 556 | Maize | Ancient Landrace | Surface sterilized seeds | Staphylococcaceae | *Staphylococcus* sp. |
| SYM00113 | 67 | 587 | Maize | Modern | Surface sterilized seeds | Staphylococcaceae | *Staphylococcus* sp. |
| SYM01257 | 67 | 992 | Rice | Ancient Landrace | Roots & Seeds | Staphylococcaceae | *Staphylococcus* sp. |
| SYM01259 | 67 | 993 | Rice | Ancient Landrace | Roots & Seeds | Staphylococcaceae | *Staphylococcus* sp. |
| SYM00071 | 76 | 565 | Teosinte | Wild relative | Surface sterilized seeds | Bacillaceae | *Bacillus* sp. |
| SYM00204 | 76 | 614 | Maize | Maize | Roots | Bacillaceae | *Bacillus* sp. |
| SYM00563 | 76 | 678 | Maize | Ancient Landrace | Seed surface wash | Bacillaceae | *Bacillus* sp. |
| SYM00617 | 76 | 719 | Teosinte | Wild relative | Seed surface wash | Bacillaceae | *Bacillus* sp. |
| SYM00016c | 82 | 530 | Rice | Modern | Surface sterilized seeds | Xanthomonadaceae | *Luteibacter* sp. |
| SYM00960 | 82 | 831 | Rice | Ancient Landrace | Surface sterilized seeds | Xanthomonadaceae | *Luteibacter* sp. |
| SYM00965 | 82 | 835 | Rice | Ancient Landrace | Surface sterilized seeds | Xanthomonadaceae | *Luteibacter* sp. |
| SYM01167 | 82 | 941 | Rice | Ancient Landrace | Roots & Seeds | Xanthomonadaceae | *Luteibacter* sp. |
| SYM00940 | 83 | 815 | Rice | Modern | Surface sterilized seeds | Enterobacteriaceae | |
| SYM00941 | 83 | 816 | Rice | Modern | Surface sterilized seeds | Enterobacteriaceae | |
| SYM00963 | 83 | 833 | Rice | Ancient Landrace | Surface sterilized seeds | Enterobacteriaceae | |
| SYM00972 | 83 | 841 | Rice | Ancient Landrace | Surface sterilized seeds | Enterobacteriaceae | |
| SYM00987 | 83 | 853 | Rice | Modern | Surface sterilized seeds | Enterobacteriaceae | |
| SYM00713 | 84 | 749 | Rice | Modern | Seed surface wash | Enterobacteriaceae | *Erwinia* sp. |
| SYM00945 | 84 | 820 | Rice | Modern | Surface sterilized seeds | Enterobacteriaceae | |
| SYM01103 | 84 | 914 | Rice | Modern | Surface sterilized seeds | Enterobacteriaceae | |
| SYM01138 | 84 | 926 | *Oryza latifolia* | Wild relative | Roots & Seeds | Enterobacteriaceae | |
| SYM01139 | 84 | 927 | *Oryza latifolia* | Wild relative | Roots & Seeds | Enterobacteriaceae | |
| SYM01180 | 84 | 950 | Rice | Modern | Roots & Seeds | Enterobacteriaceae | |
| SYM01189 | 84 | 958 | Rice | Modern | Roots & Seeds | Enterobacteriaceae | |
| SYM01193 | 84 | 961 | Rice | Modern | Roots & Seeds | Enterobacteriaceae | |
| SYM01226 | 84 | 976 | Rice | Modern | Roots & Seeds | Enterobacteriaceae | |
| SYM01229 | 84 | 978 | Rice | Modern | Roots & Seeds | Enterobacteriaceae | *Pantoea* sp. |
| SYM01230 | 84 | 979 | Rice | Modern | Roots & Seeds | Enterobacteriaceae | |
| SYM00992 | 126 | 856 | *Oryza officinalis* | Wild relative | Surface sterilized seeds | Sphingomonadaceae | *Sphingomonas* sp. |
| SYM00063 | 134 | 559 | Teosinte | Wild relative | Surface sterilized seeds | Microbacteriaceae | *Microbacterium* sp. |
| SYM00226 | 134 | 618 | Soybean | Modern | Leaves | Microbacteriaceae | *Microbacterium* sp. |
| SYM00246 | 134 | 627 | Barley | Modern | Surface sterilized seeds | Microbacteriaceae | *Microbacterium* sp. |
| SYM00524 | 134 | 653 | *Oryza nivara* | Wild relative | Seed surface wash | Microbacteriaceae | *Microbacterium* sp. |
| SYM00694a | 134 | 743 | Rice | Modern | Seed surface wash | Microbacteriaceae | *Microbacterium* sp. |
| SYM01234 | 134 | 983 | *Oryza officinalis* | Wild relative | Roots & Seeds | Microbacteriaceae | *Microbacterium* sp. |
| SYM00199 | 135 | 1448 | Maize | Maize | Roots | Bacillaceae | *Bacillus* sp. |
| SYM00172 | 146 | 592 | Rice | Modern | Surface sterilized seeds | Enterobacteriaceae | *Pantoea* sp. |
| SYM00527 | 146 | 655 | *Oryza nivara* | Wild relative | Seed surface wash | Enterobacteriaceae | *Erwinia* sp. |
| SYM00644 | 146 | 728 | Rice | Modern | Seed surface wash | Enterobacteriaceae | *Erwinia* sp. |
| SYM00648 | 146 | 732 | Rice | Modern | Seed surface wash | Enterobacteriaceae | |
| SYM00966 | 146 | 836 | Rice | Ancient Landrace | Surface sterilized seeds | Enterobacteriaceae | |
| SYM00978 | 146 | 846 | Rice | Ancient Landrace | Surface sterilized seeds | Enterobacteriaceae | |
| SYM00981 | 146 | 848 | Rice | Modern | Surface sterilized seeds | Enterobacteriaceae | |
| SYM01011 | 146 | 870 | Rice | Ancient Landrace | Surface sterilized seeds | Enterobacteriaceae | *Erwinia* sp. |
| SYM01159 | 146 | 938 | *Avena sterilis* | Wild relative | Roots & Seeds | Enterobacteriaceae | |
| SYM01175 | 146 | 945 | Rice | Ancient Landrace | Roots & Seeds | Enterobacteriaceae | |
| SYM01232 | 146 | 981 | Rice | Modern | Roots & Seeds | Enterobacteriaceae | |
| SYM01244 | 146 | 987 | Rice | Ancient Landrace | Roots & Seeds | Enterobacteriaceae | |
| SYM00538A | 172 | 658 | Maize | Ancient Landrace | Seed surface wash | Sphingomonadaceae | *Sphingomonas* sp. |
| SYM00508 | 196 | 646 | Maize | Ancient Landrace | Seed surface wash | Enterobacteriaceae | |

Legend:
For "Source of seed-origin microbe" "Surface sterilized seeds" = seed-origin microbes isolated from seeds that were surface sterilized as described in the Examples;
"Seed surface wash" = microbes derived from the surface of seeds as described in the Examples;
"Roots" = seed-origin microbes isolated from roots of seeds that were germinated in sterile culture;
"Roots & Seeds" = seed-origin microbes isolated from roots and residual seed material that was generated by germinating seeds under sterile conditions;
"Leaves" = seed-origin microbes isolated from shoots and leaves that emerged from seeds that were germinated under sterile conditions.

Example 4

In-Vitro Characterization of Bacterial Endophytes

Experiment 1

A total of 242 seed-origin bacterial endophytes representing 44 distinct OTUs as described in Example 3 were seeded onto 96 well plates and tested for various activities and/or production of compounds, as described below. Determining an endophyte's capacity to produce industrially-useful substances such as enzymes and antibiotics is useful to select which endophytes may be used in a plant bioreactor. In addition, detection of certain compounds made by the endophytes may be used as surrogate assay instead of testing directly for the presence of the endophyte by qPCR or sequencing.

The results of these in vitro assays are summarized in Table 4A. Colonies or wells with no detectable activity were scored as "-", low activity as "1," moderate activity as "2" and strong activity as "3."

Production of Auxin (SD)

To allow isolates to grow and accumulate auxin, bacterial strains were inoculated into 250 μL of R2A broth supplemented with with L-tryptophan (5 mM) in 350 μL deep, transparent flat bottom, 96 well culture plates. The plates were sealed with a breathable membrane and incubated at 28° C. under static conditions for 3 days. After 3 days the OD600 and OD530 nm were measured on a plate reader to check for bacterial growth. After measuring these ODs, 50 μL of yellowish Salkowski reagent (0.01 M FeCl3 in 35% HClO4 (perchioric acid, #311421, Sigma) were added to each well and incubated in the dark for 30 minutes before measuring the OD530 nm measured to detect pink/red color.

A very large number of bacteria showed a detectable level of pink or red colour development (the diagnostic feature of the assay suggesting auxin or indolic compound production)—169 out of 247. 89 strains had particularly strong production of auxin or indole compounds. *Erwinia* and *Pantoea* species are very similar if not identical taxonomic groups and can thus be considered together—of a total of 38 isolates, 23 had moderate or strong production of auxin or indole compounds in vitro.

Another important group of auxin producing seed-origin bacteria were *Pseudomonas* species, 9 of the 14 isolated showed significant production of indoles in this assay. *Ochrobactrum* species were also detected as strong producers of indolic compounds in this assay, with 15 of 18 showing moderate to strong color change (although all 18 had detectable colour change in this assay).

Mineral Phosphate Solubilization

Microbes were plated on tricalcium phosphate media as described in Rodriguez et al., (2001) J Biotechnol 84: 155-161 (incorporated herein by reference). This was prepared as follows: 10 g/L glucose, 0.373 g/L $NH_4NO_3$, 0.41 g/L $MgSO_4$, 0.295 g/L NaCl, 0.003 $FeCl_3$, 0.7 g/L $Ca_3HPO_4$, 100 mM Tris and 20 g/L Agar, pH 7, then autoclaved and poured into square Petri plates. After 3 days of growth at 28° C. in darkness, clear halos were measured around colonies able to solubilize the tricalcium phosphate. This was an agar based assay looking for halos around colonies which signify the solubilization of opaque tri-calcium phosphate, which resulted in a large number (95) of isolates having detectable levels of phosphate solubilization (Table 4A). Of these, at least 36 had moderate to high levels of phosphate solubilization, including several *Enterobacter* and *Pantoea* species.

Growth on Nitrogen Free LGI Media

All glassware was cleaned with 6 M HCl before media preparation. A new 96 well plate (300 ul well volume) was filled with 250 ul/well of sterile LGI broth [per L, 50 g Sucrose, 0.01 g $FeCl_3$-$6H_2O$, 0.8 g $K_3PO_4$, 0.2 g CaCl2, 0.2 g $MgSO_4$-$7H_2O$, 0.002 g $Na_2MoO_4$-$2H_2O$, pH 7.5]. Bacteria were inoculated into the 96 wells simultaneously with a flame-sterilized 96 pin replicator. The plate was sealed with a breathable membrane, incubated at 28° C. without shaking for 5 days, and $OD_{600}$ readings taken with a 96 well plate reader.

In total, of the 247 isolates there were 34 (14%) that had detectable growth under nitrogen limiting conditions (Table 4B).

TABLE 4A

Functional assays to examine the potential for seed-origin microbes to confer novel functions to crops.

| Sym Strain ID | SEQ ID NO: | Habitat origin | Taxonomy | Antagonizes E. coli | Antagonizes S. cerevisiae | Shows Cellulolytic activity | Shows Pectinolytic activity | Secretes siderophores | Phosphate Solubilization | Growth on N Free LGI | ACC Deaminase Activity | Produces Auxin/Indoles | Produces Acetoin |
|---|---|---|---|---|---|---|---|---|---|---|---|---|---|
| SYM00033 | 541 | Mexico, Mexico | Enterobacter sp. | — | — | 1 | 1 | 1 | 2 | — | — | 3 | 1 |
| SYM00173 | 593 | Louisiana, USA | Pantoea sp. | 2 | — | 1 | 1 | — | 2 | Yes | — | 3 | 1 |
| SYM00176 | 596 | India | Pantoea sp. | 1 | — | 1 | 1 | — | 1 | — | — | 2 | 1 |
| SYM00605 | 716 | Ancash, Peru | | — | — | — | — | 2 | 2 | — | — | 1 | 2 |
| SYM00607 | 717 | Ancash, Peru | | — | — | 1 | — | 2 | 2 | — | 1 | 1 | 1 |
| SYM00608 | 718 | Ancash, Peru | Pantoea sp. | — | — | 1 | 1 | 2 | 2 | — | 1 | 2 | 2 |
| SYM00620 | 720 | Ancash, Peru | Enterobacter sp. | — | — | 1 | 1 | 1 | — | — | 1 | 2 | 3 |
| SYM00658 | 736 | Holot Yavne, Israel | | 1 | — | — | — | — | 2 | — | — | 2 | 1 |
| SYM00660 | 737 | Holot Yavne, Israel | | — | 1 | — | 2 | — | — | — | — | — | — |
| SYM00011 | 522 | Durango, Mexico | Pseudomonas sp. | — | — | — | — | 1 | 1 | Yes | — | 2 | — |
| SYM00011b | — | Durango, Mexico | Pseudomonas sp. | — | 1 | — | — | 1 | — | — | — | — | 1 |
| SYM00013 | 523 | Durango, Mexico | Pseudomonas sp. | — | — | 2 | — | 2 | 2 | Yes | — | 2 | — |
| SYM00014 | 524 | Durango, Mexico | Pseudomonas sp. | — | — | 2 | 2 | 1 | 2 | Yes | — | 2 | — |
| SYM00062 | 526 | Durango, Mexico | Pseudomonas sp. | — | — | 2 | 2 | 2 | — | — | 1 | 2 | — |
| SYM00068 | 557 | Michoacan, Mexico | Pseudomonas sp. | — | — | 2 | 2 | 2 | — | — | 3 | 2 | — |
| SYM00069 | 563 | Michoacan, Mexico | Pseudomonas sp. | — | — | — | — | — | — | — | — | — | 2 |
| SYM00646 | 564 | Michoacan, Mexico | Pseudomonas sp. | — | — | 2 | 2 | 3 | — | — | 3 | 2 | — |
| SYM00649 | 730 | Segou, Mali | Pseudomonas sp. | — | — | 2 | 2 | 1 | — | — | 3 | 2 | — |
| SYM00650 | 733 | Segou, Mali | Pseudomonas sp. | — | 1 | 2 | 2 | — | — | — | 3 | 2 | — |
| SYM00657 | 734 | Segou, Mali | Pseudomonas sp. | — | — | 2 | 2 | — | 1 | — | 3 | 2 | — |
| SYM00672 | 735 | Holot Yavne, Israel | Pseudomonas sp. | — | — | 2 | 3 | 2 | — | — | — | 1 | 3 |
| SYM00709 | 738 | Valle, Honduras | Pseudomonas sp. | — | — | 3 | — | — | — | — | — | — | 1 |
| SYM00013b | 747 | Guandong, China | Curtobacterium sp. | — | — | — | — | — | — | — | — | 1 | — |
| SYM00167 | 525 | Durango, Mexico | Curtobacterium sp. | — | — | 1 | 1 | — | — | — | — | 1 | 1 |
| SYM00171 | 588 | Unknown | Curtobacterium sp. | — | — | — | — | 2 | — | — | — | 1 | 1 |
| SYM00174 | 591 | Louisiana, USA | Curtobacterium sp. | — | — | 1 | 1 | — | — | — | — | 1 | — |
| SYM00178 | 594 | Unknown | Curtobacterium sp. | — | — | 1 | 1 | — | 1 | — | — | — | 2 |
| SYM00180 | 598 | Guandong, China | Curtobacterium sp. | — | — | — | — | — | — | — | — | 3 | 3 |
| SYM00181 | 600 | Guandong, China | Curtobacterium sp. | — | — | 1 | — | — | 1 | Yes | — | — | 1 |
| SYM00235 | 601 | Guandong, China | Curtobacterium sp. | — | — | — | — | — | — | — | — | 2 | 1 |
| SYM00244 | 622 | Louisiana, USA | Curtobacterium sp. | — | — | 2 | 2 | — | — | — | 1 | 1 | — |
| SYM00525 | 626 | Rangoon, Myanmar | Curtobacterium sp. | — | — | 1 | 1 | — | — | — | 3 | 1 | 3 |
| SYM00625 | 654 | Indiana, USA | Curtobacterium sp. | — | — | — | — | 3 | — | — | — | 1 | 1 |
| SYM00645 | 724 | Segou, Mali | Curtobacterium sp. | — | — | 1 | — | — | — | — | — | 1 | 1 |
| SYM00647 | 729 | Segou, Mali | Curtobacterium sp. | — | — | — | 1 | — | — | — | 1 | 1 | — |
| SYM00690 | 731 | Hunan, China | Curtobacterium sp. | — | — | 1 | 1 | — | — | — | 1 | 1 | — |
| SYM00691 | 740 | Hunan, China | Curtobacterium sp. | — | — | — | — | — | — | — | — | — | — |
| SYM00693 | 741 | Hunan, China | Curtobacterium sp. | — | — | 1 | 1 | — | — | — | — | 1 | 1 |
| SYM00712 | 742 | Guandong, China | Curtobacterium sp. | — | — | — | — | — | — | — | — | 1 | — |
| SYM00716 | 748 | Louisiana, USA | Curtobacterium sp. | — | — | 1 | 1 | — | — | — | 1 | 1 | — |
| SYM00722 | 752 | Louisiana, USA | Curtobacterium sp. | — | — | — | — | — | — | — | — | 1 | 1 |
| SYM00731B | 753 | Louisiana, USA | Curtobacterium sp. | — | — | — | — | — | — | — | 1 | 1 | 1 |
| SYM00784 | 756 | Thailand | Curtobacterium sp. | 2 | — | — | — | — | — | — | — | — | — |
| SYM00188 | 773 | USA | Paenibacillus sp. | — | — | 1 | 1 | — | 1 | — | — | 1 | — |
| SYM00190 | 605 | USA | Paenibacillus sp. | — | — | — | — | — | — | — | — | — | 2 |
| | 607 | USA | | | | | | | | | | | |

TABLE 4A-continued

Functional assays to examine the potential for seed-origin microbes to confer novel functions to crops.

| Sym Strain ID | SEQ ID NO: | Habitat origin | Taxonomy | Antagonizes E. coli | Antagonizes S. cerevisciae | Shows Cellulolytic activity | Shows Pectinolytic activity | Secretes siderophores | Phosphate Solubilization | Growth on N Free LGI | ACC Deaminase Activity | Produces Auxin/Indoles | Produces Acetoin |
|---|---|---|---|---|---|---|---|---|---|---|---|---|---|
| SYM00195 | 610 | USA | Paenibacillus sp. | — | — | — | — | — | 2 | — | — | — | 2 |
| SYM00217 | 616 | Unknown | Paenibacillus sp. | — | — | — | — | — | 2 | — | — | — | — |
| SYM00227 | 619 | Unknown | Paenibacillus sp. | — | — | — | — | — | 1 | — | — | — | 3 |
| SYM00597 | 711 | Peru | Paenibacillus sp. | — | — | — | — | — | 1 | — | 1 | — | — |
| SYM00017b | 532 | Arkansas, USA | Pantoea sp. | — | — | 1 | 1 | — | 2 | — | — | 3 | — |
| SYM00018 | 534 | USA | Pantoea sp. | — | — | 1 | 1 | — | — | Yes | — | 2 | — |
| SYM00020 | 535 | USA | Pantoea sp. | — | — | 1 | 1 | — | 1 | — | — | 3 | 1 |
| SYM00022 | 537 | Guererro, Mexico | Pantoea sp. | — | — | 1 | 1 | 1 | — | — | — | 2 | 1 |
| SYM00025 | 538 | USA | Pantoea sp. | — | — | 1 | 1 | 1 | 2 | Yes | — | 2 | 1 |
| SYM00043 | 544 | USA | Pantoea sp. | — | — | 1 | 1 | 1 | 2 | — | — | 1 | 1 |
| SYM00047 | 546 | USA | Pantoea sp. | — | — | 1 | 1 | — | 1 | — | — | 3 | — |
| SYM00049 | 547 | USA | Pantoea sp. | — | — | 1 | 1 | 1 | — | — | — | — | — |
| SYM00055 | 553 | USA | Pantoea sp. | — | — | 1 | 1 | 1 | 2 | — | — | — | 1 |
| SYM00057 | 554 | USA | Pantoea sp. | — | — | 1 | 1 | — | — | — | — | — | 3 |
| SYM00058 | 555 | USA | Pantoea sp. | — | — | — | — | — | — | — | — | — | — |
| SYM00078 | 568 | Columbia | Pantoea sp. | 3 | 1 | 1 | 1 | 1 | 2 | Yes | — | 3 | 1 |
| SYM00081 | 569 | USA | Pantoea sp. | — | — | 1 | 1 | 1 | 2 | Yes | — | 1 | — |
| SYM00082a | 570 | USA | Pantoea sp. | — | — | — | — | 1 | — | Yes | — | 1 | 1 |
| SYM00085 | 571 | Cuba | Pantoea sp. | — | — | 1 | 1 | — | 2 | — | — | 1 | 1 |
| SYM00086 | 572 | Peru | Pantoea sp. | — | — | 1 | 1 | 1 | 2 | — | 3 | — | 3 |
| SYM00088 | 574 | USA | Pantoea sp. | — | 1 | 1 | 1 | 1 | 2 | Yes | — | 1 | 1 |
| SYM00094 | 576 | Peru | Pantoea sp. | — | — | 1 | 1 | 1 | 2 | Yes | — | 1 | 1 |
| SYM00095 | 577 | USA | Pantoea sp. | — | 1 | 1 | 1 | 1 | — | — | — | 1 | 1 |
| SYM00096 | 578 | USA | Pantoea sp. | 1 | — | 1 | 1 | 1 | 1 | — | — | 3 | 3 |
| SYM00100 | 579 | USA | Pantoea sp. | — | 1 | 1 | 1 | 1 | 1 | — | — | 2 | 1 |
| SYM00101 | 580 | USA | Pantoea sp. | — | — | 1 | 1 | 1 | 1 | — | — | 3 | 3 |
| SYM00502 | 639 | USA | Erwinia sp. | — | — | — | — | — | — | — | — | 2 | 1 |
| SYM00506b | 641 | USA | Erwinia sp. | 1 | 1 | 1 | — | 1 | 2 | — | — | 3 | 3 |
| SYM00511 | 642 | USA | Erwinia sp. | — | 1 | 1 | — | — | — | — | 3 | 3 | — |
| SYM00514b | 647 | Virgin Islands, USA | Erwinia sp. | — | 1 | 1 | — | — | — | — | 1 | 2 | 1 |
| SYM00514C | 649 | Virgin Islands, USA | Erwinia sp. | — | 1 | 1 | — | — | — | — | 1 | 3 | 3 |
| SYM00514D | 650 | Virgin Islands, USA | Erwinia sp. | — | — | — | — | — | — | — | — | — | — |
| SYM00731A | 651 | Louisiana, USA | Erwinia sp. | 1 | 1 | 1 | 1 | — | 1 | — | — | 2 | — |
| SYM00785 | 755 | Thailand | Erwinia sp. | — | 1 | — | — | — | 2 | — | — | 2 | — |
| SYM00544 | 663 | Ecuador | Ochrobactrum sp. | — | 1 | — | — | — | 1 | — | — | 3 | — |
| SYM00545B | 665 | Ecuador | Ochrobactrum sp. | — | 1 | — | — | — | — | — | — | 2 | — |
| SYM00548 | 667 | Magdalena, Colombia | Ochrobactrum sp. | — | 1 | — | — | — | 1 | — | — | 2 | — |
| SYM00552 | 670 | Magdalena, Colombia | Ochrobactrum sp. | — | — | — | — | — | — | — | — | 2 | 1 |
| SYM00558 | 675 | Nariño, Colombia | Ochrobactrum sp. | — | — | — | — | — | 1 | — | — | 2 | — |
| SYM00580b | 689 | Peru | Ochrobactrum sp. | — | — | — | — | — | — | — | — | 1 | — |
| SYM00580d | 691 | Peru | Ochrobactrum sp. | — | — | — | — | — | — | — | — | 2 | — |
| SYM00583 | 699 | Columbia | Ochrobactrum sp. | — | — | — | — | — | 1 | — | — | 2 | — |
| SYM00584 | 700 | Columbia | Ochrobactrum sp. | — | — | — | — | — | 1 | — | — | 2 | — |
| SYM00588 | 705 | Columbia | Ochrobactrum sp. | — | — | — | — | — | 2 | — | — | 2 | 2 |

TABLE 4A-continued

Functional assays to examine the potential for seed-origin microbes to confer novel functions to crops.

| Sym Strain ID | SEQ ID NO: | Habitat origin | Taxonomy | Antagonizes E. coli | Antagonizes S. cerevisciae | Shows Cellulolytic activity | Shows Pectinolytic activity | Secretes siderophores | Phosphate Solubilization | Growth on N Free LGI | ACC Deaminase Activity | Produces Auxin/Indoles | Produces Acetoin |
|---|---|---|---|---|---|---|---|---|---|---|---|---|---|
| SYM00596 | 710 | Peru | Ochrobactrum sp. | — | 1 | — | — | — | 1 | — | — | 2 | 3 |
| SYM00600 | 713 | Peru | Ochrobactrum sp. | — | 1 | — | — | — | 2 | — | — | 2 | 1 |
| SYM00746 | 757 | South Korea | Ochrobactrum sp. | 1 | 1 | — | — | — | 1 | — | 1 | 1 | — |
| SYM00752 | 759 | Mexico, Mexico | Ochrobactrum sp. | 1 | — | — | — | — | 1 | — | 1 | 2 | — |
| SYM00756 | 761 | Mexico, Mexico | Ochrobactrum sp. | 1 | — | — | — | — | 1 | — | 1 | — | — |
| SYM00763 | 767 | Mexico, Mexico | Ochrobactrum sp. | 1 | — | — | — | — | 1 | — | — | 2 | — |
| SYM00783 | 772 | Thailand | Ochrobactrum sp. | 1 | 1 | — | — | — | — | — | — | 2 | — |
| SYM00812 | 775 | Ashanti, Ghana | Ochrobactrum sp. | — | — | — | — | — | — | — | — | 2 | — |
| SYM00064a | 560 | Michoacan, Mexico | Stenotrophomonas sp. | — | — | — | — | — | — | — | — | 1 | 2 |
| SYM00183 | 603 | Amazonas, Brazil | Stenotrophomonas sp. | — | — | — | — | 1 | — | — | — | 1 | 3 |
| SYM00184 | 604 | Amazonas, Brazil | Stenotrophomonas sp. | — | — | — | — | 2 | — | — | — | 1 | — |
| SYM00543 | 662 | Ecuador | Bacillus sp. | 1 | 1 | — | — | — | — | — | — | 1 | — |
| SYM00595 | 709 | Peru | Bacillus sp. | 1 | 1 | — | — | — | — | — | — | 1 | — |
| SYM00580C | 690 | Peru | Achromobacter sp. | — | — | — | — | 1 | — | — | 1 | 1 | — |
| SYM00547 | 666 | Magdalena, Colombia | Achromobacter sp. | — | — | — | — | — | — | — | — | — | — |
| SYM00551 | 669 | Magdalena, Colombia | Achromobacter sp. | — | 1 | — | — | 1 | — | — | 2 | 1 | — |
| SYM00560 | 676 | Nariño, Colombia | Achromobacter sp. | — | — | — | — | 1 | — | — | 1 | 2 | 1 |
| SYM00565B | 681 | Mexico | Achromobacter sp. | 1 | 1 | — | — | 1 | — | — | 1 | 1 | — |
| SYM00580i | 694 | Peru | Achromobacter sp. | — | — | — | — | — | 2 | — | 1 | 2 | — |
| SYM00585 | 701 | Columbia | Achromobacter sp. | — | 1 | — | — | 1 | — | — | — | 2 | 2 |
| SYM00586b | 702 | Columbia | Achromobacter sp. | — | — | — | — | 2 | — | — | — | 2 | — |
| SYM00588b | 706 | Columbia | Achromobacter sp. | — | — | — | — | — | — | — | — | 3 | — |
| SYM00591 | 708 | Peru | Achromobacter sp. | — | — | — | — | 3 | — | — | 3 | 1 | 2 |
| SYM00602 | 715 | Ancash, Peru | Achromobacter sp. | — | — | — | — | 1 | — | — | 3 | 1 | — |
| SYM00758 | 763 | Mexico, Mexico | Achromobacter sp. | — | — | — | — | 1 | — | — | 3 | 1 | — |
| SYM00761 | 765 | Mexico, Mexico | Achromobacter sp. | — | — | — | — | 1 | 1 | — | 1 | — | — |
| SYM00764 | 768 | Mexico, Mexico | Achromobacter sp. | — | — | — | — | 1 | 1 | — | 3 | 1 | 3 |
| SYM00765 | 769 | Mexico, Mexico | Achromobacter sp. | — | — | — | — | 1 | 1 | — | 1 | — | — |
| SYM00824 | 777 | Kabul, Afghanistan | Enterobacter sp. | — | 1 | — | — | — | — | — | — | 1 | — |
| SYM00828 | 778 | Kabul, Afghanistan | Enterobacter sp. | — | — | — | — | — | — | — | — | 1 | 3 |
| SYM00830 | 779 | Kabul, Afghanistan | Enterobacter sp. | — | — | — | — | — | — | — | — | 1 | 1 |
| SYM00831 | 780 | Kabul, Afghanistan | Enterobacter sp. | — | — | — | — | — | — | — | — | — | 3 |
| SYM00028 | 540 | Arizona, U.S. | Enterobacter sp. | — | — | — | — | — | 2 | — | — | 1 | — |
| SYM00052 | 550 | Guerrero, Mexico | Enterobacter sp. | — | — | — | — | — | 2 | — | — | — | — |
| SYM00053 | 551 | Guerrero, Mexico | Enterobacter sp. | — | — | — | — | — | 2 | — | — | — | — |
| SYM00054 | 552 | Guerrero, Mexico | Enterobacter sp. | — | — | — | — | — | — | — | — | — | — |
| SYM00175 | 595 | Unknown | Enterobacter sp. | — | — | — | — | — | — | Yes | — | 1 | — |
| SYM00627 | 725 | Indiana, USA | Enterobacter sp. | 1 | 2 | — | — | — | — | — | — | — | 3 |
| SYM00715 | 751 | Guandong, China | Enterobacter sp. | — | — | — | — | — | — | — | — | — | 3 |
| SYM00189 | 606 | USA | Bacillus sp. | — | — | — | — | — | — | — | — | — | 2 |
| SYM00192 | 608 | USA | Bacillus sp. | — | — | — | — | — | — | — | — | — | 1 |
| SYM00197 | 611 | USA | Bacillus sp. | — | — | — | — | — | — | — | — | 1 | 2 |
| SYM00201 | 612 | USA | Bacillus sp. | — | — | — | — | — | — | — | — | 1 | — |
| SYM00202 | 613 | USA | Bacillus sp. | — | — | — | — | — | 2 | — | — | — | — |
| SYM00215 | 615 | Unknown | Bacillus sp. | — | — | — | — | — | — | — | — | — | 3 |

TABLE 4A-continued

Functional assays to examine the potential for seed-origin microbes to confer novel functions to crops.

| Sym Strain ID | SEQ ID NO: | Habitat origin | Taxonomy | Antagonizes E. coli | Antagonizes S. cerevisciae | Shows Cellulolytic activity | Shows Pectinolytic activity | Secretes siderophores | Phosphate Solubilization | Growth on N Free LGI | ACC Deaminase Activity | Produces Auxin/Indoles | Produces Acetoin |
|---|---|---|---|---|---|---|---|---|---|---|---|---|---|
| SYM00233 | 621 | Unknown | Bacillus sp. | — | — | — | — | — | — | Yes | — | 2 | 1 |
| SYM00016b | 529 | Arkansas, USA | Methylobacterium sp. | — | — | — | — | — | — | — | — | 1 | 1 |
| SYM00236 | 623 | Louisiana, USA | Methylobacterium sp. | — | — | 1 | 1 | — | 1 | Yes | 1 | 2 | — |
| SYM00237 | 624 | Louisiana, USA | Methylobacterium sp. | — | — | 1 | 1 | — | 1 | Yes | 1 | — | — |
| SYM00240 | 625 | Unknown | Methylobacterium sp. | — | — | 1 | 1 | — | — | Yes | 3 | — | — |
| SYM00501 | 638 | USA | Burkholderia sp. | 3 | — | — | — | 2 | — | — | 3 | 2 | — |
| SYM00504 | 640 | USA | Burkholderia sp. | 3 | 1 | — | — | 2 | — | — | 3 | 2 | — |
| SYM00536 | 656 | Oyo, Nigeria | Burkholderia sp. | 1 | 1 | — | — | 2 | 1 | — | 1 | 2 | — |
| SYM00538E | 659 | Oyo, Nigeria | Burkholderia sp. | 2 | 1 | — | — | 2 | — | — | 3 | 1 | — |
| SYM00566A | 682 | Mexico | Burkholderia sp. | 2 | 1 | — | — | 2 | 1 | — | 3 | — | 3 |
| SYM00568 | 683 | Mexico | Burkholderia sp. | 2 | 1 | — | — | 2 | 1 | — | 3 | 1 | — |
| SYM00570 | 684 | Mexico | Burkholderia sp. | 2 | 1 | — | — | 2 | 1 | — | 3 | 1 | — |
| SYM00574 | 685 | Haiti | Burkholderia sp. | 3 | 1 | — | — | 2 | 1 | — | 3 | 1 | 1 |
| SYM00575 | 686 | Haiti | Burkholderia sp. | 2 | 1 | — | — | 3 | 2 | — | 3 | — | — |
| SYM00578 | 687 | Peru | Burkholderia sp. | 2 | 1 | 1 | 1 | 3 | — | — | 3 | — | — |
| SYM00621 | 721 | Indiana, USA | Burkholderia sp. | 1 | 1 | — | — | — | 2 | — | 1 | 1 | — |
| SYM00623 | 722 | Indiana, USA | Burkholderia sp. | 1 | 1 | — | — | — | 1 | — | — | — | — |
| SYM00624 | 723 | Indiana, USA | Burkholderia sp. | — | — | — | — | 3 | — | — | — | 3 | 3 |
| SYM00633 | 727 | Peru | Burkholderia sp. | — | — | — | 1 | 3 | 2 | — | — | — | — |
| SYM00822 | 776 | Ashanti, Ghana | Burkholderia sp. | — | — | — | — | — | — | — | — | 2 | 2 |
| SYM00037 | 543 | USA | Bacillus sp. | — | 2 | — | — | 2 | — | — | — | — | 2 |
| SYM00051 | 549 | Guererro, Mexico | Microbacterium sp. | 1 | — | — | — | — | — | Yes | — | 2 | 3 |
| SYM00104 | 582 | Peru | Microbacterium sp. | — | — | — | 1 | — | — | — | — | 1 | 2 |
| SYM00177 | 597 | India | Microbacterium sp. | — | — | — | — | — | — | — | — | 2 | 2 |
| SYM00514A | 648 | Virgin Islands, USA | Microbacterium sp. | — | — | — | 1 | — | — | — | 1 | 2 | 2 |
| SYM00523 | 652 | Rangoon, Myanmar | Microbacterium sp. | — | — | — | 2 | — | — | — | 1 | 2 | 2 |
| SYM00538H | 660 | Oyo, Nigeria | Microbacterium sp. | — | — | 1 | — | 1 | — | — | — | 1 | 1 |
| SYM00542 | 661 | Ecuador | Microbacterium sp. | 1 | 1 | — | — | — | — | — | — | 3 | — |
| SYM00556 | 674 | Magdalena, Colombia | Microbacterium sp. | 1 | 1 | — | — | — | — | — | — | — | — |
| SYM00581A | 695 | Peru | Microbacterium sp. | — | — | 2 | 2 | 2 | — | — | — | 2 | 3 |
| SYM00586c | 703 | Columbia | Xanthomonas sp. | 2 | — | 3 | 3 | 2 | — | — | — | 2 | 2 |
| SYM00587 | 704 | Columbia | Xanthomonas sp. | 1 | — | 2 | 2 | — | — | Yes | — | 1 | 1 |
| SYM00598 | 712 | Mexico, Mexico | Xanthomonas sp. | — | — | — | — | — | — | — | — | 2 | 2 |
| SYM00757 | 762 | Mexico, Mexico | Xanthomonas sp. | — | — | — | — | — | — | — | — | — | 3 |
| SYM00760 | 764 | Mexico, Mexico | Xanthomonas sp. | — | — | — | — | — | 1 | Yes | — | 1 | 2 |
| SYM00780 | 771 | Kentucky, USA | Xanthomonas sp. | — | — | — | — | — | — | — | — | 1 | — |
| SYM00832 | 781 | Kabul, Afghanistan | Microbacterium sp. | — | — | — | — | — | — | — | — | 1 | 1 |
| SYM00015 | 528 | Arkansas, USA | Rhodococcus sp. | 1 | — | — | — | — | — | — | — | 1 | 1 |
| SYM00021 | 536 | Guererro, Mexico | Rhodococcus sp. | 2 | — | — | — | 2 | — | — | — | 2 | 1 |
| SYM00179 | 599 | Guandong, China | Rhodococcus sp. | 1 | — | — | — | 2 | — | — | 1 | — | 3 |
| SYM00182 | 602 | Guandong, China | Rhodococcus sp. | — | — | — | — | — | 1 | Yes | — | 3 | — |
| SYM00252 | 630 | Guandong, China | Rhodococcus sp. | — | — | — | — | — | — | — | — | — | — |
| SYM00565A | 680 | Mexico | Rhodococcus sp. | — | — | — | — | — | — | — | — | 1 | 1 |
| SYM00580G | 693 | Peru | Rhodococcus sp. | 1 | 1 | — | — | 2 | 1 | Yes | 1 | 1 | — |
| SYM00753 | 760 | Mexico, Mexico | Rhodococcus sp. | 1 | 1 | — | — | — | 1 | Yes | — | 1 | 2 |
| SYM00762 | 766 | Mexico, Mexico | Rhodococcus sp. | — | — | — | — | 1 | 1 | Yes | — | 1 | — |

TABLE 4A-continued

Functional assays to examine the potential for seed-origin microbes to confer novel functions to crops.

| Sym Strain ID | SEQ ID NO: | Habitat origin | Taxonomy | Antagonizes E. coli | Antagonizes S. cerevisciae | Shows Cellulolytic activity | Shows Pectinolytic activity | Secretes siderophores | Phosphate Solubilization | Growth on N Free LGI | ACC Deaminase Activity | Produces Auxin/Indoles | Produces Acetoin |
|---|---|---|---|---|---|---|---|---|---|---|---|---|---|
| SYM00775 | 770 | Kentucky, USA | Rhodococcus sp. | 1 | 1 | — | — | 2 | 1 | Yes | 1 | 1 | 1 |
| SYM00589 | 707 | Columbia | Paenibacillus sp. | — | 1 | — | — | 1 | — | — | — | 3 | 2 |
| SYM00057B | 1446 | USA | Burkholderia phytofirmans | — | — | 1 | 1 | — | 1 | Yes | 3 | 1 | — |
| SYM00102 | 581 | Colombia | Staphylococcus sp. | 2 | — | — | — | — | — | — | — | — | 2 |
| SYM00072 | 566 | Durango, Mexico | Bacillus sp. | 2 | — | — | — | — | — | — | — | — | 3 |
| SYM00075 | 567 | Durango, Mexico | Bacillus sp. | — | — | — | — | — | — | — | — | — | 3 |
| SYM00249 | 628 | Guangxi, China | Bacillus sp. | 2 | — | — | — | — | — | — | — | — | 1 |
| SYM00507 | 645 | USA | Bacillus sp. | — | 1 | — | — | — | — | — | — | 2 | 1 |
| SYM00553 | 671 | Magdalena, Colombia | Bacillus sp. | — | 1 | — | — | — | — | — | — | — | — |
| SYM00562 | 677 | Nariño, Colombia | Bacillus sp. | 2 | 1 | — | — | — | — | — | — | — | 1 |
| SYM00564 | 679 | Nariño, Colombia | Bacillus sp. | 2 | 1 | — | — | — | — | — | — | — | 3 |
| SYM00580E | 692 | Peru | Bacillus sp. | — | — | — | — | 1 | — | — | — | 2 | 3 |
| SYM00581b | 696 | Peru | Bacillus sp. | 2 | — | — | — | — | — | — | — | 1 | 3 |
| SYM00581c | 697 | Peru | Bacillus sp. | — | — | — | — | — | — | — | — | — | 3 |
| SYM00601 | 714 | Peru | Bacillus sp. | 1 | — | — | — | — | — | — | 1 | — | — |
| SYM00036 | 542 | USA | Bacillus sp. | 3 | 2 | — | — | — | — | — | — | 1 | 1 |
| SYM00110 | 586 | Cuba | Bacillus sp. | 3 | 1 | — | — | — | — | Yes | — | — | — |
| SYM00193 | 609 | USA | Bacillus sp. | 3 | — | — | — | — | — | — | — | — | — |
| SYM00218 | 617 | Unknown | Bacillus sp. | — | 1 | — | — | — | — | — | — | — | 3 |
| SYM00250 | 629 | Guangxi, China | Bacillus sp. | 3 | 3 | — | — | — | — | Yes | — | — | 3 |
| SYM00697 | 745 | Northern Cameroon | Bacillus sp. | 3 | 3 | — | — | — | — | — | — | — | 1 |
| SYM00704 | 746 | Northern Cameroon | Bacillus sp. | — | — | 1 | 1 | — | — | — | — | — | — |
| SYM00017c | 533 | Arkansas, USA | Sphingomonas sp. | — | — | 1 | 1 | — | — | Yes | — | 2 | 1 |
| SYM00062b | 558 | Michoacan, Mexico | Sphingomonas sp. | — | — | 1 | — | — | — | — | — | 3 | — |
| SYM00065 | 561 | Michoacan, Mexico | Sphingomonas sp. | — | 1 | 2 | 2 | — | 2 | Yes | — | 2 | 3 |
| SYM00168 | 589 | Unknown | Sphingomonas sp. | — | 1 | 2 | 2 | — | 2 | Yes | — | 3 | 3 |
| SYM00169 | 590 | Unknown | Sphingomonas sp. | — | — | 2 | 2 | 1 | 2 | Yes | — | 3 | — |
| SYM00231 | 620 | Unknown | Sphingobium sp. | — | — | — | — | 2 | 2 | — | — | 2 | — |
| SYM00975 | 843 | South Korea | Herbaspirillum sp. | — | — | — | — | — | — | — | — | 3 | 3 |
| SYM00506c | 643 | USA | Paenibacillus sp. | — | 1 | 1 | 1 | — | — | — | — | 2 | 1 |
| SYM00506D | 644 | USA | Paenibacillus sp. | — | — | — | — | — | — | — | — | 2 | — |
| SYM00545 | 664 | Ecuador | Paenibacillus sp. | — | — | — | — | — | — | — | — | 1 | — |
| SYM00549 | 668 | Magdalena, Colombia | Paenibacillus sp. | — | — | 1 | 1 | — | — | — | — | — | — |
| SYM00554 | 672 | Magdalena, Colombia | Paenibacillus sp. | — | 1 | — | — | — | — | — | — | 1 | 1 |
| SYM00555 | 673 | Magdalena, Colombia | Paenibacillus sp. | — | — | — | — | — | — | — | — | — | — |
| SYM00012 | 1447 | Durango, Mexico | Microbacterium binotii | 1 | 3 | 1 | 1 | 2 | 1 | — | — | 1 | 1 |
| SYM00046 | 545 | USA | Enterobacter sp. | 1 | 2 | 1 | 1 | 1 | 1 | — | — | 1 | 3 |
| SYM00050 | 548 | USA | Enterobacter sp. | — | 1 | 1 | 1 | — | 1 | — | — | 2 | 2 |
| SYM00628 | 726 | Indiana, USA | Enterobacter sp. | — | — | 1 | 1 | — | — | — | — | 3 | 3 |
| SYM00106 | 583 | Peru | Micrococcus sp. | — | — | — | — | — | — | Yes | 1 | — | — |
| SYM00107 | 584 | Peru | Micrococcus sp. | — | — | — | — | — | — | Yes | — | — | 1 |
| SYM00108 | 585 | Peru | Micrococcus sp. | — | — | — | — | — | — | Yes | — | — | — |

TABLE 4A-continued

Functional assays to examine the potential for seed-origin microbes to confer novel functions to crops.

| Sym Strain ID | SEQ ID NO: | Habitat origin | Taxonomy | Antagonizes E. coli | Antagonizes S. cerevisiae | Shows Cellulolytic activity | Shows Pectinolytic activity | Secretes siderophores | Phosphate Solubilization | Growth on N Free LGI | ACC Deaminase Activity | Produces Auxin/Indoles | Produces Acetoin |
|---|---|---|---|---|---|---|---|---|---|---|---|---|---|
| SYM00090 | 575 | USA | Chryseobacterium sp. | 1 | — | — | — | 1 | — | — | — | — | — |
| SYM00002 | 521 | Durango, Mexico | Agrobacterium sp. | — | — | 2 | 2 | — | — | — | — | 3 | — |
| SYM00017a | 531 | Arkansas, USA | Agrobacterium sp. | — | — | 2 | 2 | — | — | — | — | 3 | — |
| SYM00714 | 750 | Guandong, China | Agrobacterium sp. | — | — | 1 | 1 | — | — | — | 1 | 2 | — |
| SYM00060 | 556 | Peru | Staphylococcus sp. | — | — | — | — | — | — | — | — | — | 3 |
| SYM00071 | 565 | Durango, Mexico | Bacillus sp. | — | — | — | — | — | — | — | — | — | 2 |
| SYM00204 | 614 | USA | Bacillus sp. | — | — | — | — | — | — | — | — | — | — |
| SYM00563 | 678 | Narino, Colombia | Bacillus sp. | — | — | — | — | — | — | — | — | 1 | 3 |
| SYM00617 | 719 | Ancash, Peru | Bacillus sp. | — | — | — | — | — | — | — | — | — | 2 |
| SYM00960 | 831 | Louisiana, USA | Luteibacter sp. | — | — | — | — | 2 | — | — | — | — | 3 |
| SYM00940 | 815 | Zhejian, China | Erwinia sp. | — | 1 | 1 | 1 | 1 | 1 | — | 1 | 2 | 1 |
| SYM00713 | 749 | Guandong, China | Sphingomonas sp. | — | — | — | — | — | 1 | — | — | — | 2 |
| SYM00992 | 856 | Mindanao, Phillipines | | — | — | — | — | — | 2 | — | — | — | — |
| SYM00063 | 559 | Michoacan, Mexico | Microbacterium sp. | 1 | — | — | — | — | — | — | — | 1 | 3 |
| SYM00226 | 618 | Unknown | Microbacterium sp. | — | 1 | — | — | — | — | — | — | — | — |
| SYM00246 | 627 | Unknown | Microbacterium sp. | — | — | 1 | 1 | — | — | — | — | 1 | 1 |
| SYM00524 | 653 | Rangoon, Myanmar | Microbacterium sp. | — | — | 1 | 1 | — | — | — | — | 1 | 3 |
| SYM00199 | 1448 | USA | Bacillus sp. | 2 | — | — | — | — | 2 | — | — | — | — |
| SYM00172 | 592 | Louisiana, USA | Pantoea sp. | — | — | 1 | 1 | 3 | 2 | Yes | — | 3 | 3 |
| SYM00527 | 655 | Rangoon, Myanmar | Erwinia sp. | — | — | — | 1 | 1 | 1 | — | 3 | 3 | 3 |
| SYM00644 | 728 | Segou, Mali | Erwinia sp. | 1 | 1 | 1 | 1 | 1 | 1 | — | 1 | 2 | 1 |
| SYM00648 | 732 | Segou, Mali | | — | — | — | — | — | 2 | — | — | 1 | 2 |
| SYM00538A | 658 | Oyo, Nigeria | | — | — | — | 1 | — | 1 | — | — | 2 | 3 |
| SYM00508 | 646 | USA | Sphingomonas sp. | — | — | 1 | — | — | — | — | — | 2 | — |

Legend:
"—" indicates no significant increase;
"1" = low activity;
"2" = medium activity;
"3" = high activity All of these groups are known to have representatives with the potential to fix atmospheric nitrogen; however chief among these were Bacillus, Burkholderia, Enterobacter, Methylobacteria, and Pseudomonas.

TABLE 4B

| Genus | Seed-origin isolates growing on N Free Media |
|---|---|
| Bacillus sp. | 3 |
| Burkholderia sp. | 1 |
| Curtobacterium sp. | 1 |
| Enterobacter sp. | 1 |
| Methylobacterium sp. | 3 |
| Microbacterium sp. | 1 |
| Micrococcus sp. | 3 |
| Pantoea sp. | 9 |
| Pseudomonas sp. | 3 |
| Rhodococcus sp. | 3 |
| Sphingobium sp. | 1 |
| Sphingomonas sp. | 3 |
| Xanthomonas sp. | 2 |

ACC Deaminase Activity

Microbes were assayed for growth with ACC as their sole source of nitrogen. Prior to media preparation all glassware was cleaned with 6 M HCl. A 2 M filter sterilized solution of ACC (#1373A, Research Organics, USA) was prepared in water. 2 µl/mL of this was added to autoclaved LGI broth (see above), and 250 µL aliquots were placed in a brand new (clean) 96 well plate. The plate was inoculated with a 96 pin library replicator, sealed with a breathable membrane, incubated at 28° C. without shaking for 5 days, and OD600 readings taken. Only wells that were significantly more turbid than their corresponding nitrogen free LGI wells were considered to display ACC deaminase activity.

In total, of the 247 isolates there were 68 (28%) which had greater growth on nitrogen free LGI media supplemented with ACC, than in nitrogen free LGI. Of these, only 11% had very high ACC deaminase activity and these were mostly strains of Achromobacter, Burkholderia, and Pseudomonas (see Table 4C). Chief amongst these were Burkholderia species which held ACC deaminase as their most distinctive in vitro characteristic—94% or 15 out of 16 Burkholderia isolates had ACC deaminase activity. Of Burkholderia isolates, 81% had strong ACC deaminase activity, while only 42% of Achromobacter species (5 of 12 isolates) had strong ACC deaminase activity, and next were Pseudomonas where only 5 of 14 isolates (42%) had strong activity. Many Curtobacteria isolates appeared to have ACC deaminase activity as well, however these were all rated low (as 1) and thus of less interest than the preceeding groups of isolates.

TABLE 4C

| Genus | Seed-Origin Isolates growing on ACC as the sole Nitrogen Source |
|---|---|
| Achromobacter sp. | 12 |
| Agrobacterium sp. | 1 |
| Bacillus sp. | 1 |
| Burkholderia sp. | 15 |
| Curtobacterium sp. | 9 |
| Enterobacter sp. | 3 |
| Erwinia sp. | 5 |
| Methylobacterium sp. | 3 |
| Microbacterium sp. | 2 |
| Ochrobactrum sp. | 3 |
| Pantoea sp. | 1 |
| Pseudomonas sp. | 7 |

TABLE 4C-continued

| Genus | Seed-Origin Isolates growing on ACC as the sole Nitrogen Source |
|---|---|
| Rhodococcus sp. | 2 |
| Xanthomonas sp. | 1 |

Acetoin and Diacetyl Production The method was adapted from Phalip et al., (1994) J Basic Microbiol 34: 277-280. (incorporated herein by reference). 250 ml of autoclaved R2A broth supplemented with 0.5% glucose was aliquoted into a 96 well plate (#07-200-700, Fisher). The bacterial endophytes from a glycerol stock plate were inoculated into the plate using a flame-sterilized 96 pin replicator, sealed with a breathable membrane, then incubated for 3 days without shaking at 28° C. At day 5, 50 µl/well was added of freshly blended Barritt's Reagents A and B [5 g/L creatine mixed 3:1 (v/v) with freshly prepared $\alpha$-naphthol (75 g/L in 2.5 M sodium hydroxide)]. After 15 minutes, plates were scored for red or pink coloration relative to a copper colored negative control (measured as 525 nm absorption on a plate reader).

A large number of seed-origin bacteria showed a detectable level of pink or red color development (126 out of 247; See Table 4A). 70 of 247 isolates had strong production of acetoin or butanediol as detected by this assay. Bacillus (13 of 33), Enterobacter (8 or 16) and Microbacterium (12 of 21) species were the most intense producers of acetoin/butanediol in this collection. In addition, two of the three isolates of Stenotrophomonas included in this study were also strong acetoin/butanediol producers.

Siderophore Production

To ensure no contaminating iron was carried over from previous experiments, all glassware was deferrated with 6 M HCl and water prior to media preparation [Cox (1994) Methods Enzymol 235: 315-329, incorporated herein by reference]. In this cleaned glassware, R2A broth media, which is iron limited, was prepared and poured (250 ul/well) into 96 well plates and the plate then inoculated with bacteria using a 96 pin plate replicator. After 3 days of incubation at 28° C. without shaking, to each well was added 100 ul of 0-CAS preparation without gelling agent [Perez-Miranda et al. (2007), J Microbiol Methods 70: 127-131, incorporated herein by reference]. One liter of O-CAS reagent was prepared using the cleaned glassware by mixing 60.5 mg of chrome azurol S (CAS), 72.9 mg of hexadecyltrimethyl ammonium bromide (HDTMA), 30.24 g of finely crushed Piperazine-1,4-bis-2-ethanesulfonic acid (PIPES) with 10 ml of 1 mM $FeCl_3.6H_2O$ in 10 mM HCl solvent. The PIPES had to be finely powdered and mixed gently with stirring (not shaking) to avoid producing bubbles, until a deep blue color was achieved. 15 minutes after adding the reagent to each well, color change was scored by looking for purple halos (catechol type siderophores) or orange colonies (hydroxamate siderophores) relative to the deep blue of the O-CAS.

Siderophore production by bacteria on a plant surface or inside a plant may show that a microbe is equipped to grow in a nutrient limited environment. We searched for two types of siderophore that result in purple color change (catechol type siderophores) or orange color change (hydroxamate siderophores) after addition of the blue O-Cas reagent to 96 well plates. A large number of bacteria showed a detectable level of color change relative to the deep blue of the O-CAS; 80 out of 247. Notably, 32 of 247 strains had strong production of siderophores (see Table 5). Interestingly, strong siderophore producers included a large number (14) of the 16 Burkholderia isolates. Many isolates of Achromobacter (9 of 12) and *Pantoea* (15 of 26) were able to induce weak colour change in the O-CAS material.

TABLE 5

| Genus | Seed-origin Isolates Producing Strong Siderophores |
|---|---|
| *Achromobacter* sp. | 3 |
| *Burkholderia* sp. | 14 |
| *Curtobacterium* sp. | 2 |
| *Enterobacter* sp. | 1 |
| *Microbacterium* sp. | 1 |
| *Pantoea* sp. | 2 |
| *Pseudomonas* sp. | 5 |
| *Rhodococcus* sp. | 2 |
| *Xanthomonas* sp. | 2 |

Pectinase Activity

Iodine reacts with pectin to form a dark blue-colored complex, leaving clear halos as evidence of extracellular enzyme activity. Adapting a previous protocol [Soares et al. (1999) Rev de Microbiol 30: 299-303, incorporated herein by reference] 0.2% (w/v) of citrus pectin (#76280, Sigma) and 0.1% triton X-100 were added to R2A media, autoclaved and poured into 150 mm plates. Bacteria were inoculated using a 96 pin plate replicator. After 3 days of culturing in the darkness at 25° C., pectinase activity was visualized by flooding the plate with Gram's iodine. Positive colonies were surrounded by clear halos. In our study, a large number, roughly 83 of the 247 isolates, had detectable pectinase activity, and 21 of these isolates had moderate to strong results visualized as medium to large halos—caused by copious diffusion of enzyme away from the bacteria.

Cellulase Activity

Iodine reacts with cellulose to form a dark brown/blue-colored complex, leaving clear halos as evidence of extracellular enzyme activity. Adapting a previous protocol [Kasana et al. (2008), Curr Microbiol 57: 503-507, incorporated herein by reference] 0.2% carboxymethylcellulose (CMC) sodium salt (#C5678, Sigma) and 0.1% triton X-100 were added to a starch free variant of R2A media, autoclaved and poured into 150 mm plates. Bacteria were inoculated using a 96 pin plate replicator. After 3 days of culturing in the darkness at 25° C., cellulose activity was visualized by flooding the plate with Gram's iodine. Positive colonies were surrounded by clear halos.

In our study, a large number, roughly 83 of the 247 isolates, had detectable cellulose activity, and 21 of these isolates had moderate to strong results visualized as medium to large halos—caused by copious diffusion of enzyme away from the bacteria.

Antibiosis

Briefly, colonies of either *E. coli* DH5a (bacterial tester) or yeast strain *Saccharomyces cerevisiae* AH109 (fungal tester) were resuspended in 1 mL R2A broth to an OD600 of 0.2, and 40 µL of this was mixed with 40 mL of warm R2A agar for pouring a single rectangular Petri dish. Seed derived bacteria were inoculated onto plates using a flame sterilized 96 pin plate replicator, incubated for 3 days at 28° C. Antibiosis was scored by observing clear halos around endophyte colonies.

A total of 59 and 72 isolates showed antibiosis activity against either *E. coli* or yeast, respectively (Table 4A). Antibiotic production by bacteria on a plant surface or inside a plant can be used on an industrial scale. Interestingly, three groups of bacteria, the *Bacilli*, *Enterobacters* and *Burkholderia* both had a large proportion of isolates (up to 45%, 50% and 88% respectively) which were inhibiting growth of *E. coli* and yeast, suggestive of a common mechanism of antiobiosis such as production and secretion of a broad spectrum antibiotic. As antibiosis effects were detected in the same 14 strains of *Burkholderia* that produced siderophores, *Burkholderia* mediated antibiosis may have been be caused by localized iron starvation, inhibiting both yeast and *E. coli* growth. A large number of Ochrobacterum isolates also had antagonism towards yeast growth.

Experiment 2

The following bacterial endophytes were characterized: *Caulobacter* sp. (FA 13), *Pantoea* sp. (FF 34), *Sphingobium* sp. (FC 42), *Pseudomonas* sp. (FB 12), *Enterobacter* sp. FD17, *Micrococus* sp. S2, *Bacillus* sp. S4, *Pantoea* sp. S6, *Actinobacter* sp. S9, *Paenibacillus* sp. S10.

Experiment Description

Bacterial strains from overnight grown cultures in TSA broth were streaked on TSA agar plates and incubated at 30° C. After 24 h, the color and shape of colonies were noted. Cell motility and shape of single colony was observed under light microscope (Nikon, Japan).

The pH limits for bacterial growth was determined adjusted to pH values between 5 and 12 in triplicate. The dependence of bacterial growth on different salt concentrations was determined in the same medium containing 1-6% NaCl. Furthermore, the ability to grow in methanol/ethanol as sole carbon source was analyzed.

Bacterial capacity to aggregate formation may positively affect their dispersal and survival in the plant environment and adsorption to plant roots. The extent of aggregation formation was measured in six replicates following the method of Madi and Henis (1989) with some modifications. Aliquots of liquid culture containing aggregates were transferred to glass tubes and allowed to stand for 30 min. Aggregates settled down to the bottom of each tubes, and the suspension was mostly composed free of cells. The turbidity of each suspension was measured at 540 nm (ODs) with a microplate reader (Synergy 5; BioTek Instrument Inc., Winooski, USA). Cultures were then dispersed with a tissue homogenizer for 1 min and the total turbidity (OD) was measured. The percentage of aggregation was estimated as follows:

$$\% \text{ aggregation}=(ODt-ODs) \times 100/ODt$$

Motility assays (swimming, swarming and twitching) were performed following the methods of Rashid and Kornberg (2000). Swim plates (LB media contained 0.3% agarose) were inoculated in triplicates with bacteria from an overnight culture on TSA agar plates grown at 30° C. with a sterile toothpick. For swarming, plates (NB media contained 0.5% agar and glucose) were inoculated with a sterile toothpick. Twitch plates (LB broth containing 1% Difco granular agar) were stab inoculated with a sharp toothpick to the bottom of petri dish from an overnight grown culture in TSA agar plates.

Biofilm formation was analyzed using overnight grown bacterial culture in 96 well microtiter plates by staining with 1% crystal violet (CV) for 45 min. To quantify the amount of biofilm, CV was destained with 200 µl of 100% ethanol. The absorbance of 150 µl of the destained CV, which was transferred into a new microtiter plate was measured at 595 nm (modified from Djordjevic et al. 2002).

Biochemical tests such as oxidase, catalase, gelatin hydrolysis and casein hydrolysis of the selected strains were performed. Oxidase and catalase activities were tested with 1% (w/v) tetramethyl-p-phenylene diamine and 3% (v/v) hydrogen peroxide solution, respectively. Gelatin and casein hydrolysis was performed by streaking bacterial strains onto a TSA plates from the stock culture. After incubation, trichloroacetic acid (TCA) was applied to the plates and made observation immediately for a period of at least 4 min (Medina and Baresi 2007).

ACC-deaminase activity of the bacterial strains was tested on Brown & Dilworth (BD) minimal medium containing 0.7 g l$^{-1}$ ACC as a sole nitrogen source. BD plates containing 0.7 g l$^{-1}$ NH4Cl served as positive control and plates without nitrogen were used as negative control. ACC deaminase activity was recorded after 7 days of incubation at 28° C.

Auxin production by bacterial isolates both in the presence and absence of L-tryptophan (L-TRP) was determined colorimetrically and expressed as IAA equivalent (Sarwar et al. 1992). Two days old bacterial cells grown (28° C. at 180 rpm) in TSA broth supplemented with 1% L-TRP solution were harvested by centrifugation (10,000 g for 10 min). Three mL of the supernatants were mixed with 2 mL Salkowski's reagent (12 g L$^{-1}$ FeCl$_3$ in 429 ml L$^{-1}$ H$_2$SO$_4$). The mixture was incubated at room temperature for 30 min for color development and absorbance at 535 nm was measured using spectrophotometer. Auxin concentration produced by bacterial isolates was determined using standard curves for IAA prepared from serial dilutions of 10-100 µg mL$^{-1}$.

Bacterial strains were evaluated for their ability to solubilize phosphates (organic/inorganic P). Aliquots (10 µL) of overnight bacterial growth culture in TSA medium were spot inoculated onto NBRI-PBP (Mehta and Nautiyal 2001) and calcium/sodium phytate agar medium (Rosado et al. 1998). Solubilization of organic/inorganic phosphates was detected by the formation of a clear zone around the bacterial growth spot. Phosphate solubilization activity may also determined by development of clear zone around bacterial growth on Pikovskaya agar medium (Pikovskaya 1948).

Bacterial isolates were assayed for siderophores production on the Chrome azurol S (CAS) agar medium described by Schwyn and Neilands (1987). Chrome azurol S agar plates were prepared and divided into half (other half filled with Minimal medium) and spot inoculated at the border of both media with bacterial isolates and incubated at 28° C. for 5 days. The CAS agar colour changed from blue to orange or purple was considered as positive for siderophore production.

For exopolysaccharide (EPS) activity (qualitative), strains were grown on Weaver mineral media enriched with glucose and production of EPS was assessed visually (modified from Weaver et al. 1975). The EPS production was monitored as floc formation (fluffy material) on the plates after 48 h of incubation at 28° C.

Strains were tested for the production of ammonia (NH$_3$) in peptone water as described by Cappuccino and Sherman (1992). The bacterial isolates were screened for the production of hydrogen cyanide (HCN) by inoculating King's B agar plates amended with 4.4 g L$^{-1}$ glycine (Lorck 1948). Filter paper (Whatman no. 1) saturated with picrate solution (2% Na$_2$CO$_3$ in 0.5% picric acid) was placed in the lid of a petri plate inoculated with bacterial isolates. The plates were incubated at 28±2° C. for 5 days. HCN production was assessed by the color change of yellow filter paper to reddish brown.

The bacterial isolates were tested for PHB production (qualitative) following the viable colony staining methods using Nile red and Sudan black B (Liu et al. 1998; Spiekermann et al. 1999). The LB plates with overnight bacterial growth were flooded with 0.02% Sudan black B for 30 min and then washed with ethanol (96%) to remove excess strains from the colonies. The dark blue colored colonies were taken as positive for PHB production. Similarly, LB plates amended with Nile red (0.5 µL mL$^{-1}$) were exposed to UV light (312 nm) after appropriate bacterial growth to detect PHB production. Colonies of PHA-accumulating strains showed fluoresce under ultraviolet light.

The bacterial strains were tested for AHL production following the method modified from Cha et al. (1998). The LB plates containing 40 µg ml$^{-1}$ X-Gal were plated with reporter strains (*A. tumefaciens* NTL4.pZLR4). The LB plates were spot inoculated with 10 µL of bacterial culture and incubated at 28° C. for 24 h. Production of AHL activity is indicated by a diffuse blue zone surrounding the test spot of culture. *Agrobacterium tumefaciens* NTL1 (pTiC58ΔaccR) was used as positive control and plate without reporter strain was considered as negative control.

Bacterial hydrolyzing activities due to amylase, cellulase, chitinase, lipase, pectinase, protease and xylanase were screened on diagnostic plates after incubation at 28° C. Amylase activity was determined on agar plates following the protocol Männistö and Häggblom (2006). Formation of an opaque halo around colonies indicated lipase activity. Cellulase and xylanase activities were assayed on plates containing (per liter) 5 g of carboxymethyl cellulose or birch wood xylan, 1 g of peptone and 1 g of yeast extract. After 10 days of incubation, the plates were flooded with gram's iodine staining and washing with 1M NaCl to visualize the halo zone around the bacterial growth (modified from Teather and Wood 1982). Chitinase activity of the isolates was determined as zones of clearing around colonies following the method of Chernin et al. (1998). Protease activity was determined using 1% skimmed milk agar plates, while lipase activity was determined on peptone agar medium. Formation of halo zone around colonies was used as indication of activity (Smibert and Krieg 1994). Pectinase activity was determined on nutrient agar supplemented with 5 g L$^{-1}$ pectin. After 1 week of incubation, plates were flooded with 2% hexadecyl trimethyl ammonium bromide solution for 30 min. The plates were washed with 1M NaCl to visualize the halo zone around the bacterial growth (Mateos et al. 1992).

The antagonistic activities of bacterial isolates were screened against plant pathogenic bacteria (*Agrobacterium tumefaciens, Pseudomonas syringae, Escherichia coli, Staphylococcus aureus*), fungi (*Fusarium caulimons, Fusarium graminarium, Fusarium oxysporum, Fusarium solani, Rhizoctonia solani, Thielaviopsis basicola*) and oomycetes (*Phytophthora infestans, Phytophthora citricola, Phytophthora cominarum*). For antibacterial assays, the bacterial isolates and pathogen were cultivated in TSA broth at 30° C. for 24 h. The bacterial isolates were spot-inoculated (10 µL aliquots) on TSA plates pre-seeded with 100 µL tested pathogen. The plates were incubated at 28° C. for 48 h and clear zones of inhibition were recorded.

Antagonistic activity of the bacterial isolates against *fungi* and oomycetes was tasted by the dual culture technique on potato dextrose agar (PDA) and yeast malt agar (YMA) media (Dennis and Webster 1971). A small disk (5 mm) of target fungus/oomycetes was placed in the center of petri dishes of both media. Aliquots of 10 µL of overnight bacterial cultures grown in TSA were spotted 2 cm away from the center. Plates were incubated for 14 days at 24° C. and zones of inhibition were scored.

Strains were tested for tolerance towards selected heavy metals using TSA agar plates with the addition of 110 mg L-1 Cd (Cd NO3), 320 mg L-1 Cu (Cu SO4), 250 mg L-1 Cr (Cr NO3), 660 mg L-1 Pb (Pb (NO3)2), 110 mg L-1 Ni (Ni SO4) or 320 mg L-1 (Zn SO4). The plates were incubated at 28° C. for 5 days and metals tolerance was observed in terms of bacterial growth.

RNAse Activity Assay 1.5 g of torula yeast RNA (#R6625, Sigma) is dissolved in 1 mL of 0.1 M $Na_2HPO_4$ at pH 8, filter sterilized and added to 250 mL of autoclaved R2A agar media which is poured into 150 mm plates. The bacteria from a glycerol stock plate are inoculated using a flame-sterilized 96 pin replicator, and incubated at 25° C. for 3 days. On day three, plates are flooded with 70% perchloric acid (#311421, Sigma) for 15 minutes and scored for clear halo production around colonies.

Results

A range of bacterial characteristics known to contribute to plant growth promotion, stress tolerance or biocontrol was tested. The results of characterization are summarized in Tables 6 and 7.

All F-strains showed IAA production (ranging from 1.63 to 10.33 $\mu g\ mL^{-1}$ IAA-equivalent) but with variable degrees of efficacy. Several of the strains, including FA13, FF34, FC42, FB12, FD17, S4 and S10 were found to produce significant levels of siderophore when tested in agar medium containing Chrom azurol S (CAS). Three strains (FB12, S6 and S10) were found to produce AHL. Aggregation and biofilm formation were common traits in all tested strains. In the case of motility, six strains (FA13, FF34, FB12, FD17, S6 and S10) were positive for swimming, while FD17, S6 and S10 also showed swarming.

Bacteria were tested for production of exopolysaccharide (EPS) and poly-hydroxybutyrate (PHB). Five strains (FF34, FB12, FD17, S2 and S6) showed PHB production, while FA13, FC42, FD17 and S10 were found to produce EPS. Production of ammonia was commonly detected in all selected isolates but S4 and S10. In contrast, only *Pseudomonas* sp. strain FB12 was able to produce HCN.

ACC deaminase activity was found in FD17, FF34, FB12, S2, S4, S6, S9 and S10. FD17, FF34, FB12, S6 and S10 showed P-solubilization, whereas only FD17 showed production. Only FB12 was able to produce HCN. Strain S2 was the only strain not to show lipase activity. S10 was positive for amylase activity, S2 and S4 showed protease activity, and pectinase activity was observed with strains S6, S10, FF34, FB12 and FD17. All strains but FF34 and S9 were positive for cellulase and xylanase activity. Chitinase was produced by strains FB12, FD17 and S4. All strains showed antagonistic activity against one or more bacterial pathogens. All strains showed antagonism against different fungal pathogens and oomycetes but with FD17 and FB12 having higher degrees of efficacy. Strain FD17 showed highest antagonism against *F. caulimons, F. solani* and *P. citricola*.

TABLE 6

Physico-chemical and growth-promoting characteristics of maize seed-associated endophytic bacteria *Enterobacter* sp. (FD17), *Agrobacterium* sp. (FA13), *Pantoea* sp. (FF34), *Sphingobium* (FC42), *Pseudomonas* sp. (FB12) and *Micrococcus* sp. (S2).

| Characteristics | *Enterobacter* sp. (FD17) | *Agrobacterium* sp. (FA13) | *Pantoea* sp. (FF34) | *Sphingobium* sp. (FC42) | *Pseudomonas* sp. (FB12) | *Micrococcus* sp. (S2) |
|---|---|---|---|---|---|---|
| TPhenotypic and physiological characterization | | | | | | |
| Colony color | Creamy white | Grey | Yellow | Yello | Grey | Creamy |
| Colony morphology | Round | Round | Round | Round | Round | Round |
| Bacterial growth conditions<sup>a</sup> | | | | | | |
| NaCl | | | | | | |
| 2% | + | + | + | + | + | + |
| 6% | + | − | + | − | − | + |
| pH | | | | | | |
| 5 | + | + | + | + | + | + |
| 12 | + | + | − | − | + | + |
| Motility/chemotaxis<sup>b</sup> | | | | | | |
| Swimming | +++ | + | + | − | ++ | − |
| Swarming | + | − | − | − | − | − |
| Twitching | + | + | + | − | + | − |
| Biofilm formation | | | | | | |
| OD (600 nm) | 0.95 ± 0.04 | 0.92 ± 0.04 | 059 ± 0.02 | 0.95 ± 0.08 | 0.57 ± 0.08 | n.d. |
| Biofilm (595 nm) | 0.83 ± 0.06 | 0.23 ± 0.02 | 0.22 ± 0.03 | 0.08 ± 0.01 | 0.08 ± 0.04 | n.d. |
| Aggregate stability (%) | 40.22 ± 1.99 | 35.91 ± 2.57 | 26.07 ± 0.88 | 32.61 ± 2.13 | 36.38 ± 1.48 | n.d. |
| Biochemical characterization<sup>a</sup> | | | | | | |
| Catalase | + | + | + | + | + | + |
| Oxidase | − | − | − | − | + | − |
| Casein | − | − | − | − | + | − |
| Gelatin | + | − | + | − | + | + |
| Methanol | − | + | − | − | + | + |
| Ethanol | − | + | − | − | + | + |

TABLE 6-continued

Physico-chemical and growth-promoting characteristics of maize seed-associated endophytic bacteria *Enterobacter* sp. (FD17), *Agrobacterium* sp. (FA13), *Pantoea* sp. (FF34), *Sphingobium* (FC42), *Pseudomonas* sp. (FB12) and *Micrococcus* sp. (S2).

| Characteristics | *Enterobacter* sp. (FD17) | *Agrobacterium* sp. (FA13) | *Pantoea* sp. (FF34) | *Sphingobium* sp. (FC42) | *Pseudomonas* sp. (FB12) | *Micrococcus* sp. (S2) |
|---|---|---|---|---|---|---|
| Growth promoting characterization[b] | | | | | | |
| ACC-deaminase | +++ | − | ++ | − | ++ | + |
| Auxin production (IAA equivalent, µg mL$^{-1}$) | | | | | | |
| without L-TRP | 7.54 ± 1.02 | 1.74 ± 0.18 | 10.33 ± 0.35 | 4.89 ± 0.78 | 1.63 ± 0.65 | − |
| with L-TRP | 12.30 ± 0.98 | 16.13 ± 1.05 | 95.34 ± 2.14 | 38.41 ± 1.78 | 7.26 ± 1.05 | − |
| P-solubilization (inorganic/organic P) | | | | | | |
| $Ca_3(PO_4)_2$ | +++ | − | ++ | − | + | − |
| $CaHPO_4$ | +++ | ++ | ++ | − | + | − |
| $Ca(H_2PO_4)_2$ | +++ | n.d. | n.d. | n.d. | n.d. | n.d. |
| Ca-phytate | +++ | − | ++ | − | ++ | − |
| Na-phytate | +++ | − | ++ | − | ++ | − |
| Exopolysaccharide | + | ++ | − | + | − | − |
| HCN production | − | − | − | − | + | − |
| $NH_3$ production | + | + | + | + | + | + |
| Siderophore production | +++ | +++ | + | + | ++ | n.d. |
| AHL | − | − | − | − | + | − |
| PHB | + | − | + | − | + | + |
| Enzyme hydrolyzing activity[b] | | | | | | |
| Amylase | − | − | − | − | − | − |
| Cellulase | ++ | + | − | + | + | + |
| Chitinase | + | − | − | − | + | − |
| Hemolytic | + | + | + | − | + | n.d. |
| Lipase | ++ | ++ | + | + | +++ | − |
| Pectinase | + | − | + | − | + | − |
| Phosphatase | +++ | − | ++ | − | ++ | − |
| Protease | − | − | − | − | − | + |
| Xylanase | ++ | + | − | +++ | + | + |
| Heavy metal resistance (mg mL$^{-1}$)‡ | | | | | | |
| Cadmium nitrate | 120 (++) | 120 (++) | 120 (+) | − | 120 (−) | − |
| Copper sulphate | 330 (−) | 330 (+) | − | 330 (+) | 330 (−) | − |
| Chromium nitrate | 250 (++) | 250 (+) | 250 (+) | 250 (+) | 250 (+) | 250 (+) |
| Lead nitrate | 660 (++) | 660 (+) | 660 (+) | 660 (+) | 660 (+) | 660 (−) |
| Nickel sulphate | 110 (+) | 110 (+) | 110 (+) | − | − | 110 (−) |
| Zinc sulphate | 330 (+) | 330 (+) | 330 (+) | 330 (+) | − | 330 (−) |
| Antagonistic activities against plant pathogenic bacteria, fungi and oomycetes[b] | | | | | | |
| Anti-bacterial activity | | | | | | |
| *A. tumefaciens* | + | − | − | − | ++ | − |
| *P. syringae* | + | − | − | − | +++ | − |
| *E. coli* | n.d. | n.d. | n.d. | n.d. | n.d. | + |
| *S. aureus* | − | − | − | − | + | + |
| Anti-fungal activity | | | | | | |
| *F. caulimons* | +++ | ++ | + | + | ++ | − |
| *F. graminarium* | ++ | + | + | + | + | − |
| *F. oxysporum* | ++ | + | ++ | + | ++ | + |
| *F. solani* | +++ | ++ | + | ++ | ++ | − |
| *R. solani* | ++ | + | + | + | ++ | + |
| *T. basicola* | + | + | + | + | ++ | − |

TABLE 6-continued

Physico-chemical and growth-promoting characteristics of maize seed-associated endophytic bacteria *Enterobacter* sp. (FD17), *Agrobacterium* sp. (FA13), *Pantoea* sp. (FF34), *Sphingobium* (FC42), *Pseudomonas* sp. (FB12) and *Micrococcus* sp. (S2).

| Characteristics | *Enterobacter* sp. (FD17) | *Agrobacterium* sp. (FA13) | *Pantoea* sp. (FF34) | *Sphingobium* sp. (FC42) | *Pseudomonas* sp. (FB12) | *Micrococcus* sp. (S2) |
|---|---|---|---|---|---|---|
| Anti-oomycete activity | | | | | | |
| P. infestans | ++ | + | + | + | ++ | − |
| P. citricola | +++ | + | + | + | ++ | − |
| P. cominarum | ++ | + | + | + | + | − |

Results are obtained from 4-6 replicates
[a]−, absent; +, present
[b]+, low efficiency; ++, medium efficiency; +++, high efficiency

TABLE 7

Physico-chemical and growth promoting characteristics of maize seed-associated endophytic bacteria *Bacillus* sp. S4, *Pantoea* sp. S6, *Actinobacter* sp. S9, and *Paenibacillus* sp. S10

| Characteristics[†] | *Bacillus* sp. S4 | *Paenibacillus* sp. S10 | *Pantoea* sp. S6 | *Actinobacter* sp. S9 |
|---|---|---|---|---|
| Phenotypic and physiological characterization | | | | |
| Colony color | Off-white | Creamy white | Yellow | White |
| Colony morphology | Round | Round | Round | Round |
| Gram reaction | positive | negative | Negative | Negative |
| Bacterial growth conditions* | | | | |
| Temperature | | | | |
| 4° C. | + | + | + | + |
| 42° C. | − | − | − | − |
| NaCl | | | | |
| 2% | + | + | + | + |
| 6% | + | + | + | − |
| pH | | | | |
| 5 | + | + | + | + |
| 12 | − | + | + | − |
| Motility/chemotaxis[‡] | | | | |
| Swimming | − | ++ | + | − |
| Swarming | − | + | ++ | − |
| Twitching | + | + | + | − |
| Biofilm formation | | | | |
| OD (600 nm) | n.d. | n.d. | n.d. | n.d. |
| Biofilm (595 nm) | n.d. | n.d. | n.d. | n.d. |
| Aggregate stability (%) | n.d. | n.d. | n.d. | n.d. |
| Biochemical characterization* | | | | |
| Catalase | + | + | + | + |
| Oxidase | + | + | − | − |
| Casein | + | − | − | − |
| Gelatin | − | − | + | − |
| Methanol | − | + | − | + |
| Ethanol | − | + | − | + |
| Growth promoting characterization[‡] | | | | |
| ACC-deaminase activity | + | + | + | + |
| Auxin production ($\mu g\ mL^{-1}$) | | | | |
| Without L-TRP | − | − | − | − |
| With L-TRP | − | − | − | − |
| P-solubilization (Inorganic/organic P) | | | | |
| Ca3(PO4)$_2$ | − | + | + | − |
| CaHPO4 | − | + | + | − |
| Ca(H$_2$PO$_4$)$_2$ | n.d. | n.d. | n.d. | n.d. |
| Ca-Phytate | − | + | + | − |
| Na-Phytate | − | + | + | − |
| Exopolysaccharide | − | + | − | − |
| N2-fixation | − | + | + | − |
| HCN production | − | − | − | − |
| NH$_3$ production | − | − | + | + |
| Siderophore | + | + | n.d. | − |
| AHL | − | + | + | − |
| PHB | − | + | + | − |
| Enzyme hydrolyzing activity[‡] | | | | |
| Amylase | − | + | − | − |
| Cellulase | + | + | − | − |
| Chitinase | + | − | − | − |
| Hemolytic | n.d. | n.d. | n.d. | n.d. |
| Lipase | + | + | + | + |
| Pectinase | − | + | + | − |
| Phosphatase | − | + | + | − |
| Protease | + | − | − | − |
| Xylanase | + | + | + | − |
| Heavy metal resistance (mg $mL^{-1}$)[‡] | | | | |
| Cadmium nitrate | 120 (+) | − | − | − |
| Copper sulphate | 330 (+) | − | − | 330 (−) |
| Chromium nitrate | 250 (+) | 250 (+) | 250 (+) | 250 (+) |
| Lead nitrate | 660 (+) | 660 (+) | 660 (++) | 660 (+) |
| Nickel sulphate | 110 (+) | 110 (+) | 110 (+) | 110 (+) |
| Zinc sulphate | 330 (+) | 330 (+) | − | − |
| Antagonistic activities against plant pathogenic bacteria, fungi and oomycetes[‡] | | | | |

TABLE 7-continued

Physico-chemical and growth promoting characteristics of maize seed-associated endophytic bacteria *Bacillus* sp. S4, *Pantoea* sp. S6, *Actinobacter* sp. S9, and *Paenibacillus* sp. S10

| Characteristics[†] | *Bacillus* sp. S4 | *Paenibacillus* sp. S10 | *Pantoea* sp. S6 | *Actinobacter* sp. S9 |
|---|---|---|---|---|
| Anti-bacterial activity | | | | |
| *A. tumefaciens* | + | + | − | − |
| *E. coli* | + | + | − | − |
| *P. syringae* | + | + | − | − |
| *S. aureus* | + | + | + | + |
| Anti-fungal and Oomycete | | | | |
| *F. caulimons* | + | + | + | − |
| *F. graminarium* | − | + | + | + |
| *F. oxysporum* | + | − | + | − |
| *F. solani* | + | + | − | − |
| *R. solani* | + | + | + | + |
| *T. basicola* | + | + | + | − |
| Anti-Oomycete | | | | |
| *P. infestans* | − | − | + | − |
| *P. citricola* | − | + | + | + |
| *P. cominarum* | + | + | + | + |

[†]Results in characterization table are of 4-6 replicates
*−, absent; +, present
[‡]+, low efficiency; ++, medium efficiency; +++, high efficiency Example 5

Seed Endophyte Establishment and Persistence in Corn and Wheat

Seed endophytes colonize plant tissues and as part of their life cycle they can establish inside roots and disperse systemically throughout the plant vascular system and colonize stems, leaves, flowers and seeds. In order to track the fate of individual strains they are labeled with a marker such as Green Fluorescent Proteins (GFP) encoded in a multi copy plasmid. A strain is transformed with the plasmid encoding the expression of GFP that can be detected by flow cytometry with excitation with a blue laser at 488 nm and light emission at 530 nm or fluorescent microscopy. The transformed strain will fluoresce green and thus can be readily discriminated from the native microbial community as indigenous green fluorescence does not occur in seed endophytes or microbial species associated with the rhizosphere or soils. Seeds are inoculated with such bacteria which colonize the germinating seed allowing the establishment, detection and enumeration of the GFP-labeled strain in specific tissues such as roots, stems and flowers as the plants develop and mature. Through the plant's life cycle and reproductive stages the tissues can be analyzed for the presence of the GFP labeled seed-origin endophyte. This demonstrates that bacteria's ability to colonize and persist in vegetative plant tissues, in addition to seed surfaces and interiors where it was originally inoculated. Seed endophytes will be capable of propagation outside the seed and to be re-established on seeds to colonize new plant generations. Endophytes may also be stored protectively inside of seeds. In addition, endophytes will also be capable of propagation inside the plant, which may be useful to amplify itself or to produce useful industrial enzymes and microbes.

A strain of *Pantoea* representing OTU #7 and an *Enterobacter* representing OTU #56 were successfully electroporated with the broad gram negative host range plasmid, pDSK-GFPuv. This is a low copy plasmid, driving constitutive expression of very bright fluorescing GFP under UV light, in addition to carrying a constitutively expressed kanamycin resistance gene that can allow for selection against background, non-tagged microbes inherent in plant samples. These pDSK-GFPuv transformed bacteria were grown overnight in a volume of 10 mL of 50% TSB and the next day, CFUs were counted by serial dilution and plating on 50% TSA plates. At this time, 10 g of 58PM36 seed (Blue River Hybrid maize) in a sterile 50 mL conical tube was flooded with a mixture of 10 μl of plantability polymer Flo Rite 1706 and 500 μl of the GFP plasmid containing OTU #7 or OTU #56 bacteria in R2A broth. After vigorous shaking to ensure even coating of seed with bacteria, tubes were sealed and left at 25° C. for 7 days, at which time CFUs of bacteria still surviving on seed were assessed by carbide bead beating with a Fastprep24 machine for 60 seconds at 5 M/seconds. Each 15 mL Falcon tube contained 3 seeds, 2 beads and 1 mL of sterile R2A broth in the. After agitation, 20 μL of the supernatant was then serially diluted, and 50 μL of the 10× diluted and 50 μL of the 1,000× diluted plated on halves of 50% TSA plates. Two of each seed type including untreated, OTU #7-GFP and OTU #56-GFP inoculated seeds were then planted 3 cm deep in 70% ethanol cleaned pots containing heat sterilized quartz sand, and watered daily with autoclaved water for 7 days as seedlings developed. At this time, seedlings were removed and shaken free from sand, cut into roots or shoots, weighed, placed in 15 mL Falcon tubes along with two carbide beads and either 1 mL of 50% TSB for shoots or 2 mL of 50% TSB for roots. These were then homogenized by shaking on the Fastprep24 for 120 seconds at 5 M/second. 20 μL of shoot and root homogenates were then serially diluted, and 50 μL of the 10× diluted and 50 μL of the 1,000× diluted plated on halves of 50% TSA plates. Uninoculated seed were plated on antibiotic free TSA, but OTU #7-GFP and OTU #56-GFP plant extracts were placed on TSA plates containing 50 μg/ml of kanamycin. See FIG. 1B for an example of the two GFP fluorescing strains on kanamycin containing TSA plates.

Based on colony counting of serial dilutions, OTU #7-GFP inoculum was at a level of $2.74 \times 10^9$ CFU/mL (approximately $5.08 \times 10^7$ CFU/seed) when applied to seeds, and after 7 days at room temperature each seed still had about $4.44 \times 10^5$ CFUs per seed. After 7 days of growth in a greenhouse exposed to fluctuations in light, heat, moisture and atmosphere, OTU #7-GFP inoculated seeds developed into a seedling with an average of $1.24 \times 10^6$ CFU/g of root tissue and $7.93 \times 10^5$ CFU/g of shoot tissue. Thus after planting seeds with approximately $4.44 \times 10^5$ CFU of OTU #7-GFP each, seedlings germinated and grew into plantlets containing an average of $1.02 \times 10^6$ CFU GFP labeled bacteria. This represents an almost three fold increase of bacterial numbers and suggests active growth and colonization of these bacteria in the plant, rather than passive survival for a week until the time of harvest.

OTU #56-GFP inoculum was at a level of $1.69 \times 10^9$ CFU/mL (approximately $3.13 \times 10^7$ CFU/seed) when applied to seeds, and 7 days later each seed still had about $2.21 \times 10^6$ CFUs living on its surface. After 7 days of growth in a greenhouse exposed to fluctuations in light, heat, moisture and atmosphere, OTU #56-GFP inoculated seeds developed into seedlings with an average of $4.71 \times 10^6$ CFU/g of root tissue and $2.03 \times 10^4$ CFU/g of shoot tissue. Thus after planting seeds with approximately $2.21 \times 10^6$ CFU of OTU

7-GFP each, seedlings germinated and grew into plantlets containing an average of 6.06×10⁵ CFU GFP labelled bacteria.

Taken together, these two experiments successfully showed that seed derived endophytes are able to survive on a maize seed surface in large numbers under non-sterile greenhouse conditions for at least a week and are able to colonize and persist on the developing plant over time where they will have ongoing opportunities to influence and improve plant growth, health and productivity. Even longer-term storage of endophytes represent an opportunity to use the seed as a vault for these microbes.

Example 6

Colonization of Plants Grown from Seeds Coated with Endophytes

The establishment of plant-microbe interactions is contingent on close proximity. The microbiome of the host plant consists of microorganisms inside tissues as well as those living on the surface and surrounding rhizosphere. The present invention describes, among other methods, the colonization of the plant by application of endophytic microbes of the seed surface. The experiments described in this section are aimed at confirming successful colonization of plants by endophytic bacteria by direct recovery of viable colonies from various tissues of the inoculated plant. The experiments were designed to reduce background microbes by the use of surface-sterilized seeds, and planting and growing the seeds in a sterile environment, to improve the observable colonization of the plant with the inoculated bacterium.

Experimental Description—Experiment 1

Corn seeds of cultivar 58PM36 (Blue River Hybrid) were surface-sterilized by exposing them to chlorine gas overnight, using the methods described elsewhere. Sterile seeds were then inoculated with submerged in 0.5 OD overnight cultures [Tryptic Soy Broth] of strains SYM00254 (a *Micrococcus* sp. of OTU 59), SYM00284 (a *Pantoea* sp. of OTU 0), SYM00290 (an *Actinobacter* of OTU 154), or SYM00292 (a *Paenibacillus* sp. of OTU 6) and allowed to briefly air dry. The seeds were then placed in tubes filled partially with a sterile sand-vermiculite mixture [(1:1 wt/wt)] and covered with 1 inch of the mixture, watered with sterile water, sealed and incubated in a greenhouse for 7 days. After this incubation time, various tissues of the grown plants were harvested and used as donors to isolate bacteria by placing tissue section in a homogenizer [TSB 20%] and mechanical mixing. The slurry was then serially diluted in 10-fold steps to $10^{-3}$ and dilutions 1 through $10^{-3}$ were plated on TSA 20% plates (1.3% agar). Plates were incubated overnight and pictures were taken of the resulting plates as well as colony counts for CFUs.

Experimental Results—Experiment 1

Successful inoculation of corn plants by the endophytic bacteria allowed the recovery of viable, culturable cells as identified on TSA agar plates. Controls experiments using uninoculated, surface sterilized seeds were conducted and showed few, if any, bacterial cells were cultivatable from the inside suggesting inoculation with extra microbes would be easily detectable by culturing. Non surface sterilized seeds meanwhile showed a large diversity of colony types including both bacteria and *fungi* which drowned out the detection by culturing of inoculated bacteria, whereas the plants grown from surface-sterilized seeds showed a dominance of the inoculated strains readily identified by the colony morphology.

Finally, significant quantities of viable colonies were recovered from roots, shoots or seeds of corn plants inoculated with SYM00254, SYM00284, SYM00290, or SYM00292 (Table 8, FIG. 1A), confirming the successful colonization of these tissues of corn plants inoculated with the various strains. Microbes living on the seed surface can be eliminated by surface sterilization as was done here. The elimination of this background allows for the quantitation of the cells of interest.

TABLE 8

Confirmed colonization of seed origin strains in corn shoot and root tissue at 7 days after seed inoculation.

| Seed-origin microbes | Shoot tissue | Root tissue |
|---|---|---|
| SYM00254 | ++ | +++ |
| SYM00284 | +++ | +++ |
| SYM00290 | + | +++ |
| SYM00292 | ++ | +++ |

+ - <$10^4$ cells per tissue type; ++ - $10^4$ to $10^6$ cells per tissue type; +++ - >$10^6$ cells per tissue type.

Experimental Description—Experiment 2

A single colony was picked from a plate containing *B. phytofirmans* PsJN. This colony was re-suspended in sterile buffer (40 mM phosphate buffer (pH7.0) with 6% wt./vol. sucrose) and then spread over large plates to form a microbial lawn. After 1-3 days of growth (depending on strain) the lawns were scraped off the plate using an L-shaped spreader into buffer (40 mM phosphate buffer (pH7.0) with 6% wt./vol. sucrose). This bacterial suspension was then mixed 1:1 with 2% wt./vol. sodium alginate to create a final solution of 20 mM phosphate buffer (pH7.0), 3% wt./vol. sucrose and 1% wt./vol. sodium alginate. This suspension was applied to seeds at a ratio of 10 mL suspension per 600 g seeds. Seeds were shaken vigorously until observed to be fully coated.

FloRite 1706 [Becker Underwood] was then applied to the coated seeds at a ratio of 0.3 mL per 600 g of seeds. Seeds were again shaken vigorously to ensure an even coat.

The seeds were planted in a field in Tulln, Austria. Maize seedlings (height: 10-15 cm) grown at a field in Tulln, Austria were harvested by carefully pulling the whole plant including the roots out of the field soil. Three replicates were collected per hybrid, each replicate was taken from a different plot. In total 24 plants were harvested—three plants of four different hybrids either treated with *B. phytofirmans* PsJN or sterile broth. Plants were immediately brought to the labs of AIT in Tulln.

Surface-disinfected above ground plant material of seedlings were cut in small pieces and crushed using a sterile mortar. The plant material was transferred to Matrix E (MPbio DNA isolation kit from soil) homogenized by 30 sec beat beating using in a bead beater (FastPrep FP 120, Bio101, Savant Instruments, Inc., Holbrook, N.Y.). DNA was extracted with the MPbio DNA isolation kit from soil (MP Biomedicals, Solon, Ohio, USA) according to protocol provided by the manufacturer. Single seeds were used for DNA isolation.

For detection and quantification of *Burkholderia phytofirmans* (PsJN) DNA in the DNA isolated form field grown maize seedlings PsJN-specific quantitative real time PCR using a Taqman probe was performed. The probe was designed to match the DNA amplicon (transcription termination factor rho) produced by the primers 1824 Forward and 1824 Reverse (Bphyt_1824 Fw and Re). The probe is equipped with a FAM (6-FAM-phosphoramidit—fluorescent dye) on the 5' end, and a BHQ-1 (Black hole quencher 1) on the 3' end. A BioRad SsoFast Probe Supermix was used to provide the ideal conditions for the probe during the PCR (Table 9).

TABLE 9 composition of the PCR mastermix and the used PCR conditions
Real Time PCR
Bio-Rad CFX-96 Real-Time detection ystem
PCR approach

|  | Given onc. | final conc. | 1 x approach | 104 x |
|---|---|---|---|---|
| SsoFast Probe Supermix | 2 x | 1 x | 5.00 µl | 520.00 µl |
| probe | 10 µM | 0.35 µM | 0.35 µl | 36.40 µl |
| F-Primer | 10 µM | 0.5 µM | 0.50 µl | 52.00 µl |
| R-Primer | 10 µM | 0.5 µM | 0.5 µl | 52.00 µl |
| template | 0 ng/µl | 5-100 ng/µl | 1.00 µl | 104.00 µl |
| H$_2$O |  |  | 2.65 µl | 275.60 µl |
| reaction volume | 10 µl |  |  |  |
| Enzym activation | 95 °C. | 120 sec |  |  |
| Denaturierung | 95 °C. | 5 sec |  |  |
| Annealing/ Extension | 59 °C. | 10 sec | 40 x |  |

Chromosomal DNA of *B. phytofirmans* PsJN was isolated using FastDNA™ SPIN Kit for soil (MP Biomedicals, LLC) DNA concentration was determined using a Nanotrop and doing five replicate measurements. The mean value was used for further calculations. The number of DNA copies was calculated as follows:

$$\text{number of copies} = \frac{\text{DNA quantity}\left(\frac{g}{\mu l}\right)}{\text{fragment length} * 660 \text{ g/mol}} * 6,022 * 10^{23}$$

Fragment length=8214658 bp (genome of PsJN)

660 g/mol=average weight of a base pair 6,022*10^23=Avogadro constant

For absolute quantification of PsJN-DNA in the maize samples, a calibration curve was generated from the real-time qPCR results of 3 respective replicates of a 10-fold serial dilution of the chromosomal DNA extracted from *B. phytofirmans* PsJN. Unknown starting quantity of DNA copy numbers in the samples could be calculated based on the standard curve from the dilution series of known concentrations, which produced an r2 value of 0.997. All data analysis was performed by help of the software Bio-Rad CFX Manager 3.0.

Samples were considered to be positively colonized by PsJN when at least two of three technical replicates in the qPCR gave a SQ value higher than 10 and/or the Cq value was smaller than cycle 40.

Experimental Results—Experiments 2

*B. phytofirmans* PsJN colonized the aerial parts of field grown maize seedlings when coated on the surface of seeds. Nine out of twelve plants tested were found to be colonized by strain PsJN at a reproducible high level. At least two out three biological replicates per maize hybrid were positive in the qPCR assay. The detected copy number of PsJN in one gram of plant material was about 10^4.

Example 7

Localization of Microbes in the Plant and Its Environment

The localization within the plant and its environment was determined for seed endophytes from corn and wheat seeds.

Experiment Description:

To determine bacterial taxa inhabiting different plant compartments, seeds were germinated in soil in sterile tubes, and plant tissue was harvested. 12 corn seeds (Blue River hybrids, 40R73) and 12 wheat seeds (Briggs, developed by South Dakota University) were planted in separate culture tubes containing 12.5 ml of a 1:1 soil (type, supplier) to sand (v/v) mixture. 2.5 ml autoclaved deionized water was added to each tube, and they were fitted with caps. Tubes were placed in a growth chamber where plants were allowed to grow for 14 d. Rhizosphere, root, and aerial tissue was harvested using a technique similar to (Lundberg et al. 2012). Briefly, aerial tissue was removed using sterilized forceps and scissors, placed in a sterile conical tube, and rinsed with 70% ethanol and sterile deionized water to remove superficial microbial cells. Rhizosphere samples were taken by removing loose soil from roots, adding the roots with remaining soil to a 50 ml conical tube containing 10 ml sterile deionized water, vortexing the tube for 10 s, and removing the roots. Soil particles in the tubes were allowed to settle and the supernatant was decanted. Root samples were cleaned of remaining superficial soil and associated microbial cells using sterile water and forceps and a 70% ethanol rinse.

Microbial composition was assessed in each sample using high-throughput sequencing of the V4 hypervariable region of the 16S rRNA gene (Fierer et al. 2012). DNA was extracted from the samples using the PowerPlant Pro DNA extraction kit (Mo Bio Laboratories, Inc., Carlsbad, Calif.) according to the manufacturer's instructions. The DNA was subjected to 35-cycle PCR amplification with the 515f/806r primer pair containing error-correcting 12-bp barcoded primers specific to each sample in order to facilitate combining the samples prior to sequencing. To reduce the amplification of chloroplast and mitochondrial DNA, we used PNA clamps specific to the rRNA genes in these organelles (Lundberg et al. 2013). PCR products were quantified using the PicoGreen assay (Life Technologies, Inc., Grand Island, N.Y.), pooled in equimolar concentrations, and cleaned using the UltraClean kit (Mo Bio Laboratories, Inc., Carlsbad, Calif.). Cleaned DNA pools were sequenced on an Illumina MiSeq instrument at the University of Colorado Next Generation Sequencing Facility.

The raw sequence data were reassigned to distinct samples using a custom Python script, and quality filtering and OTU (i.e. operational taxonomic unit) clustering was conducted using the UPARSE pipeline (Edgar 2013). Briefly, a de novo sequence database with representative sequences for each OTU was created using a 97% similarity threshold, and raw reads were mapped to this database to calculate sequence counts per OTU per sample. Prior to creating the database, sequences were quality filtered using an expected error frequency threshold of 0.5 errors per sequence. In addition, sequences were dereplicated and singletons were removed prior to creating the database. OTUs were provided taxonomic classifications using the RDP classifier (Wang et al. 2007) trained with the Greengenes database (McDonald et al. 2012). To account for differences in the variable number of sequences per sample, each sample was rarefied to 200 sequences per sample. OTUs classified as chloroplasts or mitochondria were discarded prior to rarefaction.

Overall differences in bacterial community composition between the control and inoculated plants were evaluated using non-metric multidimensional scaling based on Bray-Curtis dissimilarities in order to visualize pairwise differences between sample communities. Permutational analysis of variance (PERMANOVA) was used to statistically test the significance of these differences. Analyses were conducted using the vegan package in R (R Core Team 2013). To determine the OTUs contributing to overall differences between treatments and control groups, mean relative abundances were calculated for each OTU within each group. Only OTUs with a mean relative abundance of 0.25% in either group were included in this analysis.

Experiment Results

Figure 46:
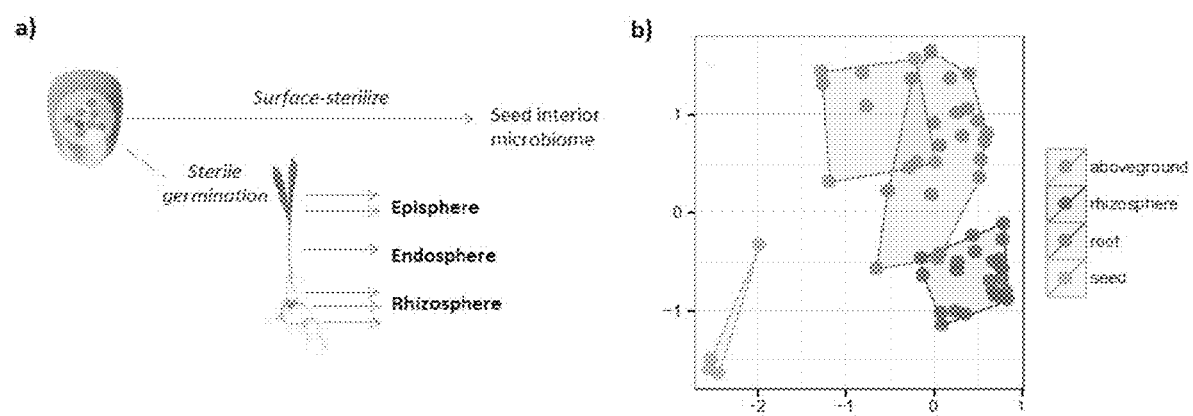
FIG. 46 shows the community differences for samples taken from above ground, root, and rhizosphere tissues of plant-based bioreactors. Panel a shows the schematic of the process for germinating seeds under sterile conditions with a diverse initial seed microbiome and subsequent sampling of the above ground (episphere), endosphere (root), and rhizosphere communities via bar-coded community sequencing. Panel b shows that distinct bacterial communities live within the different plant tissues, with each tissue being populated from microbes derived from the initial seed microbiome.
Figure 47:
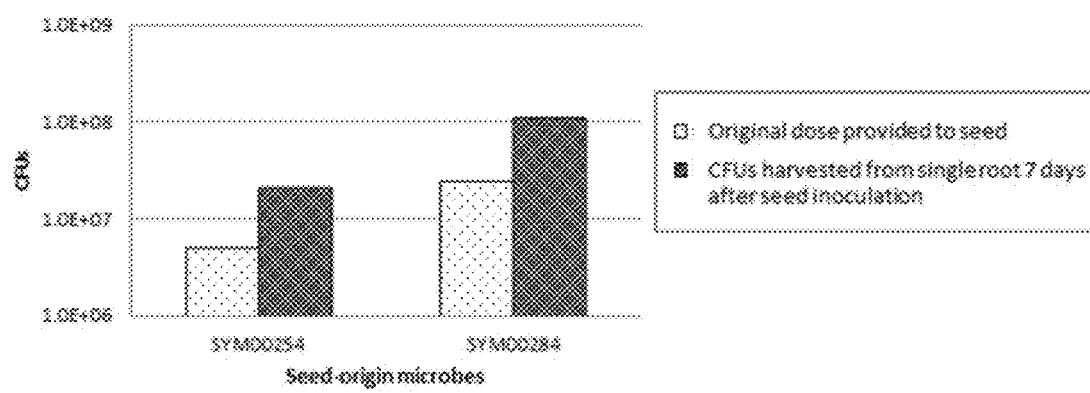
FIG. 47, panel a is a graph of seed-origin microbes SYM00254 and SYM00284 were coated on the outside of surface sterilized corn seeds, planted in axenic conditions and incubated for 7 days to germinate. The dose delivered to the seed surface was quantified by serial dilution and plating of liquid inoculum, while the microbial population colonizing roots after 7 days of incubation was quantified by macerating roots, serial dilution, plating and colony counting to obtain CFUs per root.
Figure 47:
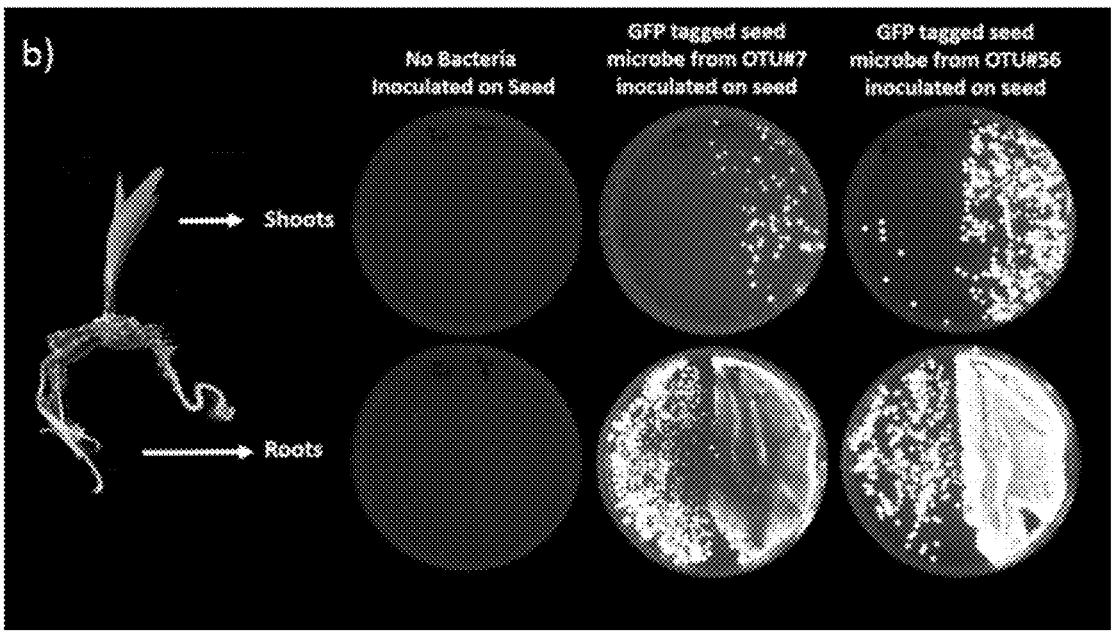
Figure 48:
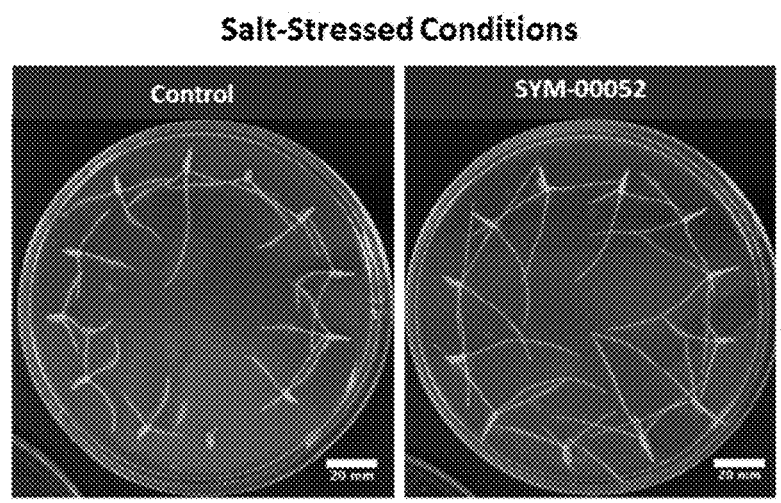
FIG. 48 contains representative photographs of seedlings. The seedlings inoculated with SYM-00052 (right) outperformed uninoculated control seedlings (left) under salt stress conditions with 100 mM NaCl in media. This provides an example of how a microbe's ability to interact with and populate plant-bioreactors can be initially screened by observing the morphology of the inoculated plant.
Figure 49:
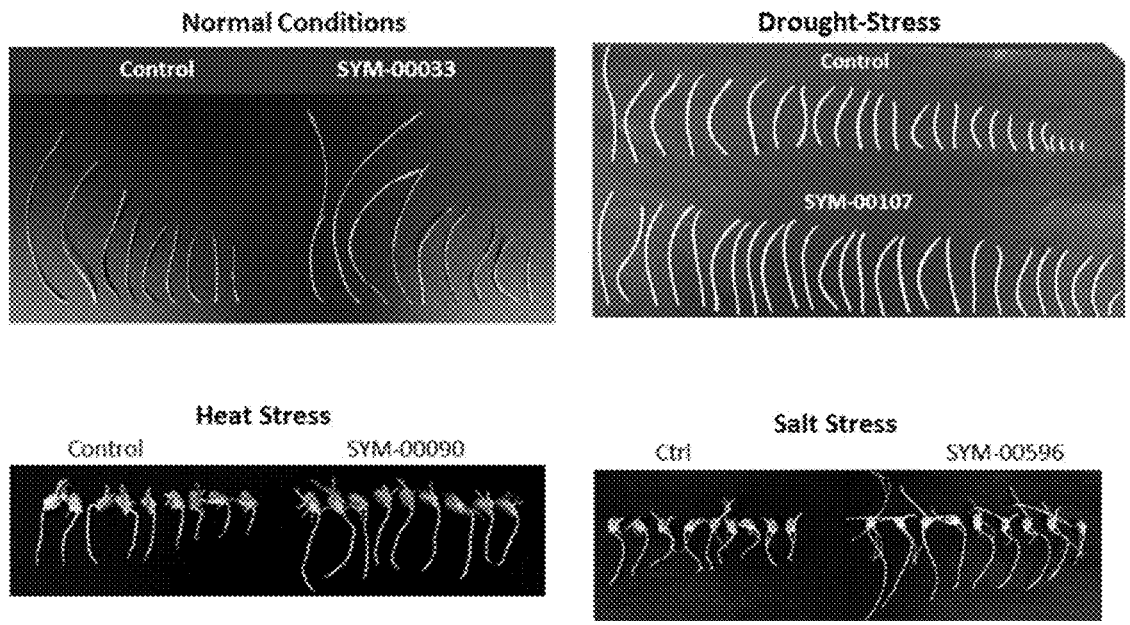
FIG. 49 contains representative photographs of seedlings. Improved vigor or growth of wheat (above) and corn (below) plant-based bioreactors inoculated with seed-borne endophytes was observed. Top left: wheat seeds were inoculated with SYM00033 and germinated under normal conditions. Top right: wheat seedlings inoculated with SYM00107 show enhanced growth under drought stress compared to uninoculated controls. Bottom left: SYM00090 inoculated corn seeds show improved growth under heat stress when compared with controls. Bottom right: corn seedlings inoculated with SYM00596 display enhanced growth under salt stress.

The bacterial taxa that are found in the root, aerial, seed tissue and/or rhizosphere of the germinated corn and wheat seeds are shown in Tables 10, 11, 12, and 13 respectively. FIG. 46 shows the community differences for samples taken from above ground, root, and rhizosphere tissues of plant-based bioreactors.

TABLE 10

Bacterial endophytes found in the root tissue

| OTU_ID | SEQ ID NO: | Class | Order | Family | Genus |
|---|---|---|---|---|---|
| OTU_73 | 2532 | Gammaproteobacteria | Xanthomonadales | Xanthomonadaceae | Xanthomonas |
| OTU_188 | 2553 | Actinobacteria | Actinomycetales | Microbacteriaceae | Salinibacterium |
| OTU_90 | 2552 | Gammaproteobacteria | Pseudomonadales | Moraxellaceae | Acinetobacter |
| OTU_115 | 2494 | Betaproteobacteria | Methylophilales | Methylophilaceae | Methylotenera |
| OTU_13 | 2528 | Bacilli | Bacillales | Bacillaceae | Bacillus |
| OTU_3194 | 2513 | Alphaproteobacteria | Sphingomonadales | Sphingomonadaceae | Sphingomonas |
| OTU_3034 | 2487 | Alphaproteobacteria | Sphingomonadales | Sphingomonadaceae | Novosphingobium |
| OTU_127 | 2469 | Alphaproteobacteria | BD7-3 | | |
| OTU_134 | 2550 | Bacilli | Bacillales | Paenibacillaceae | Paenibacillus |
| OTU_64 | 2499 | Alphaproteobacteria | Sphingomonadales | Sphingomonadaceae | Novosphingobium |
| OTU_290 | 2444 | [Saprospirae] | [Saprospirales] | Chitinophagaceae | Sediminibacterium |
| OTU_118 | 2419 | Gammaproteobacteria | Enterobacteriales | Enterobacteriaceae | Enterobacter |
| OTU_3760 | 2527 | Betaproteobacteria | Burkholderiales | Alcaligenaceae | Achromobacter |
| OTU_2272 | 2420 | Betaproteobacteria | Burkholderiales | Comamonadaceae | Polaromonas |
| OTU_99 | 2525 | [Saprospirae] | [Saprospirales] | Chitinophagaceae | |
| OTU_119 | 2447 | Sphingobacteriia | Sphingobacteriales | Sphingobacteriaceae | |
| OTU_24 | 2453 | Flavobacteriia | Flavobacteriales | [Weeksellaceae] | Chryseobacterium |
| OTU_85 | 2431 | Alphaproteobacteria | Caulobacterales | Caulobacteraceae | Phenylobacterium |
| OTU_108 | 2470 | Bacilli | Bacillales | Paenibacillaceae | Ammoniphilus |
| OTU_121 | 2561 | Bacilli | Bacillales | Paenibacillaceae | Paenibacillus |
| OTU_2406 | 2549 | Bacilli | Bacillales | Paenibacillaceae | Cohnella |
| OTU_3268 | 2445 | Cytophagia | Cytophagales | Cytophagaceae | Dyadobacter |
| OTU_604 | 2518 | Alphaproteobacteria | Sphingomonadales | Erythrobacteraceae | |
| OTU_367 | 2558 | Alphaproteobacteria | Sphingomonadales | Erythrobacteraceae | |
| OTU_124 | 2556 | Alphaproteobacteria | Rhodospirillales | Rhodospirillaceae | Azospirillum |
| OTU_343 | 2524 | Cytophagia | Cytophagales | Cytophagaceae | Dyadobacter |
| OTU_130 | 2531 | Flavobacteriia | Flavobacteriales | Flavobacteriaceae | Flavobacterium |
| OTU_89 | 2491 | Bacilli | Bacillales | | |
| OTU_70 | 2433 | Cytophagia | Cytophagales | Cytophagaceae | |
| OTU_65 | 2427 | Verrucomicrobiae | Verrucomicrobiales | Verrucomicrobiaceae | Prosthecobacter |
| OTU_43 | 2437 | Sphingobacteriia | Sphingobacteriales | Sphingobacteriaceae | Pedobacter |
| OTU_3678 | 2547 | Gammaproteobacteria | Xanthomonadales | Xanthomonadaceae | Rhodanobacter |
| OTU_123 | 2539 | Actinobacteria | Actinomycetales | Micrococcaceae | Arthrobacter |
| OTU_79 | 2478 | [Saprospirae] | [Saprospirales] | Chitinophagaceae | Flavisolibacter |
| OTU_87 | 2481 | [Saprospirae] | [Saprospirales] | Chitinophagaceae | |
| OTU_264 | 2542 | Bacilli | Bacillales | Paenibacillaceae | Paenibacillus |
| OTU_217 | 2489 | Bacilli | Bacillales | Planococcaceae | Paenisporosarcina |
| OTU_9 | 2479 | Gammaproteobacteria | Pseudomonadales | Pseudomonadaceae | Pseudomonas |
| OTU_1 | 2424 | Gammaproteobacteria | Enterobacteriales | Enterobacteriaceae | Pantoea |
| OTU_69 | 2452 | Betaproteobacteria | IS-44 | | |
| OTU_139 | 2514 | Bacilli | Bacillales | | |
| OTU_399 | 2458 | Verrucomicrobiae | Verrucomicrobiales | Verrucomicrobiaceae | Luteolibacter |
| OTU_104 | 2526 | Bacilli | Bacillales | Paenibacillaceae | Paenibacillus |
| OTU_71 | 2523 | Alphaproteobacteria | Rhizobiales | Bradyrhizobiaceae | Bradyrhizobium |
| OTU_72 | 2439 | [Saprospirae] | [Saprospirales] | Chitinophagaceae | Sediminibacterium |
| OTU_204 | 2541 | Alphaproteobacteria | Rhizobiales | Rhizobiaceae | Agrobacterium |
| OTU_141 | 2555 | Alphaproteobacteria | Sphingomonadales | Sphingomonadaceae | Sphingomonas |
| OTU_50 | 2551 | Alphaproteobacteria | Sphingomonadales | Sphingomonadaceae | Sphingomonas |
| OTU_56 | 2454 | Deltaproteobacteria | Myxococcales | | |
| OTU_16 | 2425 | Bacilli | Bacillales | Paenibacillaceae | Paenibacillus |
| OTU_2969 | 2430 | Bacilli | Bacillales | Bacillaceae | |
| OTU_183 | 2521 | Alphaproteobacteria | Caulobacterales | Caulobacteraceae | Mycoplana |
| OTU_61 | 2488 | Cytophagia | Cytophagales | Cytophagaceae | Dyadobacter |
| OTU_75 | 2475 | [Saprospirae] | [Saprospirales] | Chitinophagaceae | Flavisolibacter |
| OTU_68 | 2471 | Betaproteobacteria | Burkholderiales | Comamonadaceae | |
| OTU_76 | 2461 | Gammaproteobacteria | Xanthomonadales | Xanthomonadaceae | Rhodanobacter |
| OTU_2017 | 2474 | Sphingobacteriia | Sphingobacteriales | Sphingobacteriaceae | Pedobacter |
| OTU_29 | 2477 | Gammaproteobacteria | Xanthomonadales | Xanthomonadaceae | |
| OTU_86 | 2530 | Alphaproteobacteria | Caulobacterales | Caulobacteraceae | Caulobacter |
| OTU_78 | 2457 | [Saprospirae] | [Saprospirales] | Chitinophagaceae | |

TABLE 10-continued

Bacterial endophytes found in the root tissue

| OTU_ID | SEQ ID NO: | Class | Order | Family | Genus |
|---|---|---|---|---|---|
| OTU_22 | 2510 | Bacilli | Bacillales | Paenibacillaceae | *Cohnella* |
| OTU_2460 | 2473 | Betaproteobacteria | Burkholderiales | Oxalobacteraceae | *Janthinobacterium* |
| OTU_66 | 2497 | Flavobacteriia | Flavobacteriales | Flavobacteriaceae | *Flavobacterium* |
| OTU_3062 | 2490 | Bacilli | Bacillales | Paenibacillaceae | *Cohnella* |
| OTU_18 | 2484 | Bacilli | Bacillales | Paenibacillaceae | *Paenibacillus* |
| OTU_2966 | 2522 | Alphaproteobacteria | Rhizobiales | Hyphomicrobiaceae | *Devosia* |
| OTU_54 | 2511 | Sphingobacteriia | Sphingobacteriales | | |
| OTU_92 | 2493 | Deltaproteobacteria | Myxococcales | Polyangiaceae | *Chondromyces* |
| OTU_60 | 2546 | Bacilli | Bacillales | Paenibacillaceae | *Paenibacillus* |
| OTU_63 | 2480 | Planctomycetia | Pirellulales | Pirellulaceae | |
| OTU_2433 | 2483 | Alphaproteobacteria | Rhizobiales | Rhizobiaceae | |
| OTU_95 | 2496 | [Saprospirae] | [Saprospirales] | Chitinophagaceae | |
| OTU_62 | 2564 | Alphaproteobacteria | Sphingomonadales | Sphingomonadaceae | *Sphingomonas* |
| OTU_356 | 2498 | Betaproteobacteria | Burkholderiales | Comamonadaceae | *Simplicispira* |
| OTU_176 | 2516 | Alphaproteobacteria | Caulobacterales | Caulobacteraceae | *Mycoplana* |
| OTU_91 | 2455 | Deltaproteobacteria | Myxococcales | | |
| OTU_148 | 2537 | Betaproteobacteria | Burkholderiales | Comamonadaceae | |
| OTU_53 | 2533 | Flavobacteriia | Flavobacteriales | Flavobacteriaceae | *Flavobacterium* |
| OTU_3272 | 2535 | Bacilli | Bacillales | Paenibacillaceae | *Brevibacillus* |
| OTU_2819 | 2456 | Alphaproteobacteria | Rhizobiales | Hyphomicrobiaceae | *Devosia* |
| OTU_57 | 2472 | Alphaproteobacteria | Rhizobiales | Hyphomicrobiaceae | *Devosia* |
| OTU_1751 | 2467 | Gammaproteobacteria | Alteromonadales | Alteromonadaceae | *Cellvibrio* |
| OTU_67 | 2548 | Bacilli | Bacillales | Paenibacillaceae | *Paenibacillus* |
| OTU_41 | 2468 | Cytophagia | Cytophagales | Cytophagaceae | *Cytophaga* |
| OTU_51 | 2529 | Alphaproteobacteria | Rhizobiales | Rhizobiaceae | *Agrobacterium* |
| OTU_77 | 2545 | Betaproteobacteria | Burkholderiales | Comamonadaceae | |
| OTU_7 | 2451 | Cytophagia | Cytophagales | Cytophagaceae | *Dyadobacter* |
| OTU_52 | 2554 | Deinococci | Deinococcales | Deinococcaceae | *Deinococcus* |
| OTU_28 | 2495 | Alphaproteobacteria | Rhizobiales | Hyphomicrobiaceae | *Devosia* |
| OTU_23 | 2485 | [Saprospirae] | [Saprospirales] | Chitinophagaceae | *Chitinophaga* |
| OTU_37 | 2438 | Verrucomicrobiae | Verrucomicrobiales | Verrucomicrobiaceae | *Luteolibacter* |
| OTU_721 | 2448 | Flavobacteriia | Flavobacteriales | Flavobacteriaceae | *Flavobacterium* |
| OTU_45 | 2460 | Gammaproteobacteria | Alteromonadales | Alteromonadaceae | *Cellvibrio* |
| OTU_42 | 2476 | Alphaproteobacteria | Caulobacterales | Caulobacteraceae | *Asticcacaulis* |
| OTU_10 | 2515 | Gammaproteobacteria | Xanthomonadales | Xanthomonadaceae | *Stenotrophomonas* |
| OTU_44 | 2426 | Alphaproteobacteria | Rhizobiales | Rhizobiaceae | *Rhizobium* |
| OTU_3676 | 2520 | Gammaproteobacteria | Pseudomonadales | Pseudomonadaceae | *Pseudomonas* |
| OTU_49 | 2443 | Betaproteobacteria | Burkholderiales | Oxalobacteraceae | *Janthinobacterium* |
| OTU_3658 | 2462 | Alphaproteobacteria | Rhizobiales | | |
| OTU_35 | 2563 | Bacilli | Bacillales | Paenibacillaceae | *Paenibacillus* |
| OTU_2846 | 2436 | Alphaproteobacteria | Rhizobiales | Rhizobiaceae | *Shinella* |
| OTU_34 | 2557 | Bacilli | Bacillales | Paenibacillaceae | *Paenibacillus* |
| OTU_33 | 2536 | Bacilli | Bacillales | Paenibacillaceae | *Brevibacillus* |
| OTU_17 | 2432 | Flavobacteriia | Flavobacteriales | Flavobacteriaceae | *Flavobacterium* |
| OTU_32 | 2459 | Betaproteobacteria | Burkholderiales | Comamonadaceae | *Rhodoferax* |
| OTU_15 | 2534 | Bacilli | Bacillales | Paenibacillaceae | *Paenibacillus* |
| OTU_2408 | 2562 | Gammaproteobacteria | Enterobacteriales | Enterobacteriaceae | |
| OTU_5 | 2466 | Alphaproteobacteria | Rhizobiales | Rhizobiaceae | *Agrobacterium* |
| OTU_4 | 2540 | Gammaproteobacteria | Pseudomonadales | Pseudomonadaceae | *Pseudomonas* |
| OTU_3 | 2464 | Betaproteobacteria | Burkholderiales | Oxalobacteraceae | *Janthinobacterium* |

TABLE 11

Bacterial endophytes found in the shoot tissue

| OTU_ID | SEQ ID NO: | Class | Order | Family | Genus |
|---|---|---|---|---|---|
| OTU_37 | 2438 | Verrucomicrobiae | Verrucomicrobiales | Verrucomicrobiaceae | *Luteolibacter* |
| OTU_721 | 2448 | Flavobacteriia | Flavobacteriales | Flavobacteriaceae | *Flavobacterium* |
| OTU_2819 | 2456 | Alphaproteobacteria | Rhizobiales | Hyphomicrobiaceae | *Devosia* |
| OTU_45 | 2460 | Gammaproteobacteria | Alteromonadales | Alteromonadaceae | *Cellvibrio* |
| OTU_3658 | 2462 | Alphaproteobacteria | Rhizobiales | | |
| OTU_1300 | 2463 | Deinococci | Deinococcales | Deinococcaceae | *Deinococcus* |
| OTU_1751 | 2467 | Gammaproteobacteria | Alteromonadales | Alteromonadaceae | *Cellvibrio* |
| OTU_57 | 2472 | Alphaproteobacteria | Rhizobiales | Hyphomicrobiaceae | *Devosia* |
| OTU_75 | 2475 | [Saprospirae] | [Saprospirales] | Chitinophagaceae | *Flavisolibacter* |
| OTU_87 | 2481 | [Saprospirae] | [Saprospirales] | Chitinophagaceae | |
| OTU_217 | 2489 | Bacilli | Bacillales | Planococcaceae | *Paenisporosarcina* |
| OTU_95 | 2496 | [Saprospirae] | [Saprospirales] | Chitinophagaceae | |
| OTU_66 | 2497 | Flavobacteriia | Flavobacteriales | Flavobacteriaceae | *Flavobacterium* |
| OTU_22 | 2510 | Bacilli | Bacillales | Paenibacillaceae | *Cohnella* |
| OTU_54 | 2511 | Sphingobacteriia | Sphingobacteriales | | |
| OTU_3194 | 2513 | Alphaproteobacteria | Sphingomonadales | Sphingomonadaceae | *Sphingomonas* |

TABLE 11-continued

Bacterial endophytes found in the shoot tissue

| OTU_ID | SEQ ID NO: | Class | Order | Family | Genus |
|---|---|---|---|---|---|
| OTU_588 | 2519 | Bacilli | Bacillales | | |
| OTU_2966 | 2522 | Alphaproteobacteria | Rhizobiales | Hyphomicrobiaceae | *Devosia* |
| OTU_51 | 2529 | Alphaproteobacteria | Rhizobiales | Rhizobiaceae | *Agrobacterium* |
| OTU_86 | 2530 | Alphaproteobacteria | Caulobacterales | Caulobacteraceae | *Caulobacter* |
| OTU_3272 | 2535 | Bacilli | Bacillales | Paenibacillaceae | *Brevibacillus* |
| OTU_52 | 2554 | Deinococci | Deinococcales | Deinococcaceae | *Deinococcus* |
| OTU_70 | 2433 | Cytophagia | Cytophagales | Cytophagaceae | |
| OTU_72 | 2439 | [Saprospirae] | [Saprospirales] | Chitinophagaceae | *Sediminibacterium* |
| OTU_290 | 2444 | [Saprospirae] | [Saprospirales] | Chitinophagaceae | *Sediminibacterium* |
| OTU_96 | 2446 | Betaproteobacteria | | | |
| OTU_399 | 2458 | Verrucomicrobiae | Verrucomicrobiales | Verrucomicrobiaceae | *Luteolibacter* |
| OTU_23 | 2485 | [Saprospirae] | [Saprospirales] | Chitinophagaceae | *Chitinophaga* |
| OTU_3034 | 2487 | Alphaproteobacteria | Sphingomonadales | Sphingomonadaceae | *Novosphingobium* |
| OTU_176 | 2516 | Alphaproteobacteria | Caulobacterales | Caulobacteraceae | *Mycoplana* |
| OTU_33 | 2536 | Bacilli | Bacillales | Paenibacillaceae | *Brevibacillus* |
| OTU_134 | 2550 | Bacilli | Bacillales | Paenibacillaceae | *Paenibacillus* |
| OTU_1 | 2424 | Gammaproteobacteria | Enterobacteriales | Enterobacteriaceae | *Pantoea* |
| OTU_178 | 2434 | [Saprospirae] | [Saprospirales] | Chitinophagaceae | |
| OTU_2433 | 2483 | Alphaproteobacteria | Rhizobiales | Rhizobiaceae | |
| OTU_356 | 2498 | Betaproteobacteria | Burkholderiales | Comamonadaceae | *Simplicispira* |
| OTU_1884 | 2435 | Gammaproteobacteria | Enterobacteriales | Enterobacteriaceae | *Escherichia* |
| OTU_81 | 2442 | [Spartobacteria] | [Chthoniobacterales] | [Chthoniobacteraceae] | |
| OTU_24 | 2453 | Flavobacteriia | Flavobacteriales | [Weeksellaceae] | *Chryseobacterium* |
| OTU_85 | 2431 | Alphaproteobacteria | Caulobacterales | Caulobacteraceae | *Phenylobacterium* |
| OTU_483 | 2450 | Rubrobacteria | Rubrobacterales | Rubrobacteraceae | *Rubrobacter* |
| OTU_173 | 2486 | Actinobacteria | Actinomycetales | Nocardioidaceae | *Aeromicrobium* |
| OTU_557 | 2500 | Bacilli | Bacillales | Paenibacillaceae | *Paenibacillus* |
| OTU_584 | 2501 | Bacilli | Bacillales | Paenibacillaceae | *Paenibacillus* |
| OTU_1618 | 2503 | Bacilli | Lactobacillales | Streptococcaceae | *Streptococcus* |
| OTU_881 | 2507 | Clostridia | Clostridiales | Clostridiaceae | *Caloramator* |
| OTU_3561 | 2509 | Actinobacteria | Actinomycetales | Actinomycetaceae | *Actinomyces* |
| OTU_240 | 2512 | [Saprospirae] | [Saprospirales] | Chitinophagaceae | |
| OTU_148 | 2537 | Betaproteobacteria | Burkholderiales | Comamonadaceae | |
| OTU_1004 | 2543 | Alphaproteobacteria | Ellin329 | | |
| OTU_3042 | 2544 | Alphaproteobacteria | Sphingomonadales | Sphingomonadaceae | *Novosphingobium* |
| OTU_141 | 2555 | Alphaproteobacteria | Sphingomonadales | Sphingomonadaceae | *Sphingomonas* |
| OTU_367 | 2558 | Alphaproteobacteria | Sphingomonadales | Erythrobacteraceae | |
| OTU_1534 | 2429 | Betaproteobacteria | Burkholderiales | Oxalobacteraceae | |
| OTU_64 | 2499 | Alphaproteobacteria | Sphingomonadales | Sphingomonadaceae | *Novosphingobium* |
| OTU_3738 | 2502 | Actinobacteria | Actinomycetales | Microbacteriaceae | *Microbacterium* |
| OTU_1137 | 2505 | Clostridia | Clostridiales | Clostridiaceae | *Thermoanaerobacterium* |
| OTU_183 | 2521 | Alphaproteobacteria | Caulobacterales | Caulobacteraceae | *Mycoplana* |
| OTU_71 | 2523 | Alphaproteobacteria | Rhizobiales | Bradyrhizobiaceae | *Bradyrhizobium* |
| OTU_99 | 2525 | [Saprospirae] | [Saprospirales] | Chitinophagaceae | |
| OTU_130 | 2531 | Flavobacteriia | Flavobacteriales | Flavobacteriaceae | *Flavobacterium* |
| OTU_123 | 2539 | Actinobacteria | Actinomycetales | Micrococcaceae | *Arthrobacter* |
| OTU_204 | 2541 | Alphaproteobacteria | Rhizobiales | Rhizobiaceae | *Agrobacterium* |
| OTU_3678 | 2547 | Gammaproteobacteria | Xanthomonadales | Xanthomonadaceae | *Rhodanobacter* |
| OTU_124 | 2556 | Alphaproteobacteria | Rhodospirillales | Rhodospirillaceae | *Azospirillum* |
| OTU_118 | 2419 | Gammaproteobacteria | Enterobacteriales | Enterobacteriaceae | *Enterobacter* |
| OTU_873 | 2449 | Betaproteobacteria | Burkholderiales | Alcaligenaceae | |
| OTU_343 | 2524 | Cytophagia | Cytophagales | Cytophagaceae | *Dyadobacter* |
| OTU_53 | 2533 | Flavobacteriia | Flavobacteriales | Flavobacteriaceae | *Flavobacterium* |
| OTU_3268 | 2445 | Cytophagia | Cytophagales | Cytophagaceae | *Dyadobacter* |
| OTU_2547 | 2482 | Gammaproteobacteria | Pseudomonadales | Pseudomonadaceae | |
| OTU_615 | 2421 | Clostridia | Thermoanaerobacterales | Carboxydocellaceae | *Carboxydocella* |
| OTU_272 | 2428 | Bacilli | Bacillales | Bacillaceae | *Geobacillus* |
| OTU_68 | 2471 | Betaproteobacteria | Burkholderiales | Comamonadaceae | |
| OTU_42 | 2476 | Alphaproteobacteria | Caulobacterales | Caulobacteraceae | *Asticcacaulis* |
| OTU_29 | 2477 | Gammaproteobacteria | Xanthomonadales | Xanthomonadaceae | |
| OTU_9 | 2479 | Gammaproteobacteria | Pseudomonadales | Pseudomonadaceae | *Pseudomonas* |
| OTU_188 | 2553 | Actinobacteria | Actinomycetales | Microbacteriaceae | *Salinibacterium* |
| OTU_61 | 2488 | Cytophagia | Cytophagales | Cytophagaceae | *Dyadobacter* |
| OTU_3760 | 2527 | Betaproteobacteria | Burkholderiales | Alcaligenaceae | *Achromobacter* |
| OTU_43 | 2437 | Sphingobacteriia | Sphingobacteriales | Sphingobacteriaceae | *Pedobacter* |
| OTU_1703 | 2504 | Gammaproteobacteria | Pasteurellales | Pasteurellaceae | *Haemophilus* |
| OTU_2846 | 2436 | Alphaproteobacteria | Rhizobiales | Rhizobiaceae | *Shinella* |
| OTU_28 | 2495 | Alphaproteobacteria | Rhizobiales | Hyphomicrobiaceae | *Devosia* |
| OTU_661 | 2508 | Gammaproteobacteria | Xanthomonadales | Sinobacteraceae | *Steroidobacter* |
| OTU_3 | 2464 | Betaproteobacteria | Burkholderiales | Oxalobacteraceae | *Janthinobacterium* |
| OTU_502 | 2465 | Bacilli | Bacillales | Sporolactobacillaceae | *Bacillus* |
| OTU_115 | 2494 | Betaproteobacteria | Methylophilales | Methylophilaceae | *Methylotenera* |
| OTU_631 | 2506 | Betaproteobacteria | Rhodocyclales | Rhodocyclaceae | *Methyloversatilis* |
| OTU_436 | 2423 | Clostridia | Clostridiales | Clostridiaceae | *Thermoanaerobacterium* |
| OTU_7 | 2451 | Cytophagia | Cytophagales | Cytophagaceae | *Dyadobacter* |
| OTU_4 | 2540 | Gammaproteobacteria | Pseudomonadales | Pseudomonadaceae | *Pseudomonas* |

TABLE 11-continued

Bacterial endophytes found in the shoot tissue

| OTU_ID | SEQ ID NO: | Class | Order | Family | Genus |
|---|---|---|---|---|---|
| OTU_319 | 2422 | Bacilli | Bacillales | Staphylococcaceae | *Staphylococcus* |
| OTU_32 | 2459 | Betaproteobacteria | Burkholderiales | Comamonadaceae | *Rhodoferax* |
| OTU_90 | 2552 | Gammaproteobacteria | Pseudomonadales | Moraxellaceae | *Acinetobacter* |
| OTU_50 | 2551 | Alphaproteobacteria | Sphingomonadales | Sphingomonadaceae | *Sphingomonas* |
| OTU_10 | 2515 | Gammaproteobacteria | Xanthomonadale s | Xanthomonadaceae | *Stenotrophomonas* |
| OTU_44 | 2426 | Alphaproteobacteria | Rhizobiales | Rhizobiaceae | *Rhizobium* |
| OTU_2969 | 2430 | Bacilli | Bacillales | Bacillaceae | |
| OTU_77 | 2545 | Betaproteobacteria | Burkholderiales | Comamonadaceae | |
| OTU_73 | 2532 | Gammaproteobacteria | Xanthomonadales | Xanthomonadaceae | *Xanthomonas* |
| OTU_3676 | 2520 | Gammaproteobacteria | Pseudomonadales | Pseudomonadaceae | *Pseudomonas* |
| OTU_2408 | 2562 | Gammaproteobacteria | Enterobacteriales | Enterobacteriaceae | |
| OTU_16 | 2425 | Bacilli | Bacillales | Paenibacillaceae | *Paenibacillus* |
| OTU_2272 | 2420 | Betaproteobacteria | Burkholderiales | Comamonadaceae | *Polaromonas* |
| OTU_5 | 2466 | Alphaproteobacteria | Rhizobiales | Rhizobiaceae | *Agrobacterium* |

TABLE 12

Bacterial endophytes found in the seed

| OTU_ID | SEQ ID NO: | Class | Order | Family | Genus |
|---|---|---|---|---|---|
| OTU_77 | 2545 | Betaproteobacteria | Burkholderiales | Comamonadaceae | |
| OTU_32 | 2459 | Betaproteobacteria | Burkholderiales | Comamonadaceae | *Rhodoferax* |
| OTU_2408 | 2562 | Gammaproteobacteria | Enterobacteriales | Enterobacteriaceae | |
| OTU_502 | 2465 | Bacilli | Bacillales | Sporolactobacillaceae | *Bacillus* |
| OTU_164 | 2492 | Cytophagia | Cytophagales | Cytophagaceae | *Hymenobacter* |
| OTU_3194 | 2513 | Alphaproteobacteria | Sphingomonadales | Sphingomonadaceae | *Sphingomonas* |
| OTU_604 | 2518 | Alphaproteobacteria | Sphingomonadales | Erythrobacteraceae | |
| OTU_1300 | 2463 | Deinococci | Deinococcales | Deinococcaceae | *Deinococcus* |
| OTU_436 | 2423 | Clostridia | Clostridiales | Clostridiaceae | *Thermoanaerobacterium* |
| OTU_777 | 2441 | Bacilli | Bacillales | Alicyclobacillaceae | *Alicyclobacillus* |
| OTU_290 | 2444 | [Saprospirae] | [Saprospirales] | Chitinophagaceae | *Sediminibacterium* |
| OTU_4 | 2540 | Gammaproteobacteria | Pseudomonadales | Pseudomonadaceae | *Pseudomonas* |
| OTU_2547 | 2482 | Gammaproteobacteria | Pseudomonadales | Pseudomonadaceae | |
| OTU_13 | 2528 | Bacilli | Bacillales | Bacillaceae | *Bacillus* |
| OTU_1363 | 2440 | Bacilli | Bacillales | Staphylococcaceae | |
| OTU_9 | 2479 | Gammaproteobacteria | Pseudomonadales | Pseudomonadaceae | *Pseudomonas* |
| OTU_89 | 2491 | Bacilli | Bacillales | | |
| OTU_2969 | 2430 | Bacilli | Bacillales | Bacillaceae | |
| OTU_71 | 2523 | Alphaproteobacteria | Rhizobiales | Bradyrhizobiaceae | *Bradyrhizobium* |
| OTU_272 | 2428 | Bacilli | Bacillales | Bacillaceae | *Geobacillus* |
| OTU_2272 | 2420 | Betaproteobacteria | Burkholderiales | Comamonadaceae | *Polaromonas* |
| OTU_16 | 2425 | Bacilli | Bacillales | Paenibacillaceae | *Paenibacillus* |
| OTU_1884 | 2435 | Gammaproteobacteria | Enterobacteriales | Enterobacteriaceae | *Escherichia* |
| OTU_3 | 2464 | Betaproteobacteria | Burkholderiales | Oxalobacteraceae | *Janthinobacterium* |
| OTU_1 | 2424 | Gammaproteobacteria | Enterobacteriales | Enterobacteriaceae | *Pantoea* |
| OTU_118 | 2419 | Gammaproteobacteria | Enterobacteriales | Enterobacteriaceae | *Enterobacter* |

TABLE 13

Bacterial endophytes found in the rhizosphere

| OTU_ID | SEQ ID NO: | Class | Order | Family | Genus |
|---|---|---|---|---|---|
| OTU_2460 | 2473 | Betaproteobacteria | Burkholderiales | Oxalobacteraceae | *Janthinobacterium* |
| OTU_604 | 2518 | Alphaproteobacteria | Sphingomonadales | Erythrobacteraceae | |
| OTU_173 | 2486 | Actinobacteria | Actinomycetales | Nocardioidaceae | *Aeromicrobium* |
| OTU_1004 | 2543 | Alphaproteobacteria | Ellin329 | | |
| OTU_3042 | 2544 | Alphaproteobacteria | Sphingomonadales | Sphingomonadaceae | *Novosphingobium* |
| OTU_118 | 2419 | Gammaproteobacteria | Enterobacteriales | Enterobacteriaceae | *Enterobacter* |
| OTU_2547 | 2482 | Gammaproteobacteria | Pseudomonadales | Pseudomonadaceae | |
| OTU_3760 | 2527 | Betaproteobacteria | Burkholderiales | Alcaligenaceae | *Achromobacter* |
| OTU_91 | 2455 | Deltaproteobacteria | Myxococcales | | |
| OTU_183 | 2521 | Alphaproteobacteria | Caulobacterales | Caulobacteraceae | *Mycoplana* |
| OTU_73 | 2532 | Gammaproteobacteria | Xanthomonadales | Xanthomonadaceae | *Xanthomonas* |
| OTU_16 | 2425 | Bacilli | Bacillales | Paenibacillaceae | *Paenibacillus* |
| OTU_164 | 2492 | Cytophagia | Cytophagales | Cytophagaceae | *Hymenobacter* |
| OTU_367 | 2558 | Alphaproteobacteria | Sphingomonadales | Erythrobacteraceae | |
| OTU_92 | 2493 | Deltaproteobacteria | Myxococcales | Polyangiaceae | *Chondromyces* |

TABLE 13-continued

Bacterial endophytes found in the rhizosphere

| OTU_ID | SEQ ID NO: | Class | Order | Family | Genus |
|---|---|---|---|---|---|
| OTU_2819 | 2456 | Alphaproteobacteria | Rhizobiales | Hyphomicrobiaceae | Devosia |
| OTU_95 | 2496 | [Saprospirae] | [Saprospirales] | Chitinophagaceae | |
| OTU_2433 | 2483 | Alphaproteobacteria | Rhizobiales | Rhizobiaceae | |
| OTU_204 | 2541 | Alphaproteobacteria | Rhizobiales | Rhizobiaceae | Agrobacterium |
| OTU_9 | 2479 | Gammaproteobacteria | Pseudomonadales | Pseudomonadaceae | Pseudomonas |
| OTU_188 | 2553 | Actinobacteria | Actinomycetales | Microbacteriaceae | Salinibacterium |
| OTU_90 | 2552 | Gammaproteobacteria | Pseudomonadales | Moraxellaceae | Acinetobacter |
| OTU_2969 | 2430 | Bacilli | Bacillales | Bacillaceae | |
| OTU_62 | 2564 | Alphaproteobacteria | Sphingomonadales | Sphingomonadaceae | Sphingomonas |
| OTU_2966 | 2522 | Alphaproteobacteria | Rhizobiales | Hyphomicrobiaceae | Devosia |
| OTU_240 | 2512 | [Saprospirae] | [Saprospirales] | Chitinophagaceae | |
| OTU_115 | 2494 | Betaproteobacteria | Methylophilales | Methylophilaceae | Methylotenera |
| OTU_2272 | 2420 | Betaproteobacteria | Burkholderiales | Comamonadaceae | Polaromonas |
| OTU_13 | 2528 | Bacilli | Bacillales | Bacillaceae | Bacillus |
| OTU_141 | 2555 | Alphaproteobacteria | Sphingomonadales | Sphingomonadaceae | Sphingomonas |
| OTU_124 | 2556 | Alphaproteobacteria | Rhodospirillales | Rhodospirillaceae | Azospirillum |
| OTU_343 | 2524 | Cytophagia | Cytophagales | Cytophagaceae | Dyadobacter |
| OTU_44 | 2426 | Alphaproteobacteria | Rhizobiales | Rhizobiaceae | Rhizobium |
| OTU_57 | 2472 | Alphaproteobacteria | Rhizobiales | Hyphomicrobiaceae | Devosia |
| OTU_52 | 2554 | Deinococci | Deinococcales | Deinococcaceae | Deinococcus |
| OTU_99 | 2525 | [Saprospirae] | [Saprospirales] | Chitinophagaceae | |
| OTU_130 | 2531 | Flavobacteriia | Flavobacteriales | Flavobacteriaceae | Flavobacterium |
| OTU_3678 | 2547 | Gammaproteobacteria | Xanthomonadales | Xanthomonadaceae | Rhodanobacter |
| OTU_89 | 2491 | Bacilli | Bacillales | | |
| OTU_35 | 2563 | Bacilli | Bacillales | Paenibacillaceae | Paenibacillus |
| OTU_721 | 2448 | Flavobacteriia | Flavobacteriales | Flavobacteriaceae | Flavobacterium |
| OTU_1751 | 2467 | Gammaproteobacteria | Alteromonadales | Alteromonadaceae | Cellvibrio |
| OTU_1 | 2424 | Gammaproteobacteria | Enterobacteriales | Enterobacteriaceae | Pantoea |
| OTU_123 | 2539 | Actinobacteria | Actinomycetales | Micrococcaceae | Arthrobacter |
| OTU_60 | 2546 | Bacilli | Bacillales | Paenibacillaceae | Paenibacillus |
| OTU_3194 | 2513 | Alphaproteobacteria | Sphingomonadales | Sphingomonadaceae | Sphingomonas |
| OTU_86 | 2530 | Alphaproteobacteria | Caulobacterales | Caulobacteraceae | Caulobacter |
| OTU_148 | 2537 | Betaproteobacteria | Burkholderiales | Comamonadaceae | |
| OTU_10 | 2515 | Gammaproteobacteria | Xanthomonadales | Xanthomonadaceae | Stenotrophomonas |
| OTU_79 | 2478 | [Saprospirae] | [Saprospirales] | Chitinophagaceae | Flavisolibacter |
| OTU_779 | 2538 | Bacilli | Bacillales | Paenibacillaceae | Paenibacillus |
| OTU_138 | 2560 | Bacilli | Bacillales | Paenibacillaceae | Paenibacillus |
| OTU_3034 | 2487 | Alphaproteobacteria | Sphingomonadales | Sphingomonadaceae | Novosphingobium |
| OTU_49 | 2443 | Betaproteobacteria | Burkholderiales | Oxalobacteraceae | Janthinobacterium |
| OTU_127 | 2469 | Alphaproteobacteria | BD7-3 | | |
| OTU_67 | 2548 | Bacilli | Bacillales | Paenibacillaceae | Paenibacillus |
| OTU_3658 | 2462 | Alphaproteobacteria | Rhizobiales | | |
| OTU_51 | 2529 | Alphaproteobacteria | Rhizobiales | Rhizobiaceae | Agrobacterium |
| OTU_119 | 2447 | Sphingobacteriia | Sphingobacteriales | Sphingobacteriaceae | |
| OTU_101 | 2517 | Bacilli | Bacillales | Paenibacillaceae | |
| OTU_176 | 2516 | Alphaproteobacteria | Caulobacterales | Caulobacteraceae | Mycoplana |
| OTU_2846 | 2436 | Alphaproteobacteria | Rhizobiales | Rhizobiaceae | Shinella |
| OTU_50 | 2551 | Alphaproteobacteria | Sphingomonadales | Sphingomonadaceae | Sphingomonas |
| OTU_76 | 2461 | Gammaproteobacteria | Xanthomonadales | Xanthomonadaceae | Rhodanobacter |
| OTU_63 | 2480 | Planctomycetia | Pirellulales | Pirellulaceae | |
| OTU_54 | 2511 | Sphingobacteriia | Sphingobacteriales | | |
| OTU_134 | 2550 | Bacilli | Bacillales | Paenibacillaceae | Paenibacillus |
| OTU_356 | 2498 | Betaproteobacteria | Burkholderiales | Comamonadaceae | Simplicispira |
| OTU_53 | 2533 | Flavobacteriia | Flavobacteriales | Flavobacteriaceae | Flavobacterium |
| OTU_78 | 2457 | [Saprospirae] | [Saprospirales] | Chitinophagaceae | |
| OTU_66 | 2497 | Flavobacteriia | Flavobacteriales | Flavobacteriaceae | Flavobacterium |
| OTU_96 | 2446 | Betaproteobacteria | | | |
| OTU_41 | 2468 | Cytophagia | Cytophagales | Cytophagaceae | Cytophaga |
| OTU_87 | 2481 | [Saprospirae] | [Saprospirales] | Chitinophagaceae | |
| OTU_24 | 2453 | Flavobacteriia | Flavobacteriales | [Weeksellaceae] | Chryseobacterium |
| OTU_69 | 2452 | Betaproteobacteria | IS-44 | | |
| OTU_2017 | 2474 | Sphingobacteriia | Sphingobacteriales | Sphingobacteriaceae | Pedobacter |
| OTU_139 | 2514 | Bacilli | Bacillales | | |
| OTU_264 | 2542 | Bacilli | Bacillales | Paenibacillaceae | Paenibacillus |
| OTU_178 | 2434 | [Saprospirae] | [Saprospirales] | Chitinophagaceae | |
| OTU_61 | 2488 | Cytophagia | Cytophagales | Cytophagaceae | Dyadobacter |
| OTU_81 | 2442 | [Spartobacteria] | [Chthoniobacterales] | [Chthoniobacteraceae] | |
| OTU_85 | 2431 | Alphaproteobacteria | Caulobacterales | Caulobacteraceae | Phenylobacterium |
| OTU_399 | 2458 | Verrucomicrobiae | Verrucomicrobiales | Verrucomicrobiaceae | Luteolibacter |
| OTU_108 | 2470 | Bacilli | Bacillales | Paenibacillaceae | Ammoniphilus |
| OTU_70 | 2433 | Cytophagia | Cytophagales | Cytophagaceae | |
| OTU_77 | 2545 | Betaproteobacteria | Burkholderiales | Comamonadaceae | |
| OTU_3676 | 2520 | Gammaproteobacteria | Pseudomonadales | Pseudomonadaceae | Pseudomonas |
| OTU_104 | 2526 | Bacilli | Bacillales | Paenibacillaceae | Paenibacillus |
| OTU_75 | 2475 | [Saprospirae] | [Saprospirales] | Chitinophagaceae | Flavisolibacter |
| OTU_71 | 2523 | Alphaproteobacteria | Rhizobiales | Bradyrhizobiaceae | Bradyrhizobium |

TABLE 13-continued

Bacterial endophytes found in the rhizosphere

| OTU_ID | SEQ ID NO: | Class | Order | Family | Genus |
|---|---|---|---|---|---|
| OTU_121 | 2561 | Bacilli | Bacillales | Paenibacillaceae | Paenibacillus |
| OTU_588 | 2519 | Bacilli | Bacillales | | |
| OTU_64 | 2499 | Alphaproteobacteria | Sphingomonadales | Sphingomonadaceae | Novosphingobium |
| OTU_56 | 2454 | Deltaproteobacteria | Myxococcales | | |
| OTU_2406 | 2549 | Bacilli | Bacillales | Paenibacillaceae | Cohnella |
| OTU_3272 | 2535 | Bacilli | Bacillales | Paenibacillaceae | Brevibacillus |
| OTU_65 | 2427 | Verrucomicrobiae | Verrucomicrobiales | Verrucomicrobiaceae | Prosthecobacter |
| OTU_217 | 2489 | Bacilli | Bacillales | Planococcaceae | Paenisporosarcina |
| OTU_72 | 2439 | [Saprospirae] | [Saprospirales] | Chitinophagaceae | Sediminibacterium |
| OTU_45 | 2460 | Gammaproteobacteria | Alteromonadales | Alteromonadaceae | Cellvibrio |
| OTU_43 | 2437 | Sphingobacteriia | Sphingobacteriales | Sphingobacteriaceae | Pedobacter |
| OTU_98 | 2559 | Bacilli | Bacillales | Paenibacillaceae | Paenibacillus |
| OTU_68 | 2471 | Betaproteobacteria | Burkholderiales | Comamonadaceae | |
| OTU_29 | 2477 | Gammaproteobacteria | Xanthomonadales | Xanthomonadaceae | |
| OTU_28 | 2495 | Alphaproteobacteria | Rhizobiales | Hyphomicrobiaceae | Devosia |
| OTU_3268 | 2445 | Cytophagia | Cytophagales | Cytophagaceae | Dyadobacter |
| OTU_32 | 2459 | Betaproteobacteria | Burkholderiales | Comamonadaceae | Rhodoferax |
| OTU_23 | 2485 | [Saprospirae] | [Saprospirales] | Chitinophagaceae | Chitinophaga |
| OTU_42 | 2476 | Alphaproteobacteria | Caulobacterales | Caulobacteraceae | Asticcacaulis |
| OTU_3062 | 2490 | Bacilli | Bacillales | Paenibacillaceae | Cohnella |
| OTU_17 | 2432 | Flavobacteriia | Flavobacteriales | Flavobacteriaceae | Flavobacterium |
| OTU_34 | 2557 | Bacilli | Bacillales | Paenibacillaceae | Paenibacillus |
| OTU_15 | 2534 | Bacilli | Bacillales | Paenibacillaceae | Paenibacillus |
| OTU_37 | 2438 | Verrucomicrobiae | Verrucomicrobiales | Verrucomicrobiaceae | Luteolibacter |
| OTU_33 | 2536 | Bacilli | Bacillales | Paenibacillaceae | Brevibacillus |
| OTU_22 | 2510 | Bacilli | Bacillales | Paenibacillaceae | Cohnella |
| OTU_2408 | 2562 | Gammaproteobacteria | Enterobacteriales | Enterobacteriaceae | |
| OTU_4 | 2540 | Gammaproteobacteria | Pseudomonadales | Pseudomonadaceae | Pseudomonas |
| OTU_7 | 2451 | Cytophagia | Cytophagales | Cytophagaceae | Dyadobacter |
| OTU_18 | 2484 | Bacilli | Bacillales | Paenibacillaceae | Paenibacillus |
| OTU_5 | 2466 | Alphaproteobacteria | Rhizobiales | Rhizobiaceae | Agrobacterium |
| OTU_3 | 2464 | Betaproteobacteria | Burkholderiales | Oxalobacteraceae | Janthinobacterium |

Example 8

Testing of Seed-Origin Bacterial Endophyte Populations on Plants

The results shown above demonstrate that many of the endophytic bacteria described herein possess activities that may be useful to help in their propagation and storage within plants and plant parts. Many of the bacteria described here are capable of producing compounds that could be industrially useful, as detected using the in vitro assays described above. In addition, several representative bacteria were tested and found to successfully colonize corn plants as demonstrated in the example above.

However, determining colonization by the methods described above or others is not always the fastest and easiest way to determine whether the endophyte is successfully stored and/or propagating within the plant. The experiments in this section can be surrogate assays to determine the presence of an endophyte within a plant by assessing beneficial traits in the bioreactor plant. Several surrogate assays methods can be used. First, plants inoculated with bacteria were tested under conditions without any stress. If the microbe is present within the plant, the plant may show an increase in vigor. Second, endophyte-inoculated plants were tested under specific stress conditions (e.g., salt stress, heat stress, drought stress, and combinations thereof). These conditions may better reveal the presence of certain endophytes. These growth tests were performed using three different means: using growth assays on water-agar plates; using growth assays on sterile filter papers; and growth assays on magenta boxes.

Experimental Description

Surface sterilization of seeds—Un-treated organic maize seeds (Blue River hybrids, 40R73) and wheat seeds (Briggs, developed by South Dakota University) were sterilized overnight with chlorine gas as follows: 200 g of seeds were weighed and placed in a 250 mL glass bottle. The opened bottle and its cap were placed in a dessicator jar in a fume hood. A beaker containing 100 mL of commercial bleach (8.25% sodium hypochlorite) was placed in the dessicator jar. Immediately prior to sealing the jar, 3 mL of concentrated hydrochloric acid (34-37.5%) was carefully added to the bleach. The sterilization was left to proceed for 18-24 h. After sterilization, the bottle was closed with its sterilized cap, and reopened in a sterile flow hood. The opened bottle was left in the sterile hood for a couple hours to air out the seeds and remove chlorine gas leftover. The bottle was then closed and the seeds stored at room temperature in the dark until use.

Seedling Vigor Assessment in Normal and Stressed Conditions on Water Agar

Bacterial endophytes isolated from seeds as described herein were inoculated onto maize and wheat seeds and the plant was grown under normal and stressed conditions on water agar. For each bacterial endophyte tested, 5 mL of liquid R2A medium was inoculated with a single colony and the culture grown at room temperature on a shaker to an OD (600 nm) of between 0.8 and 1.2.

Sterilized maize and wheat seeds were placed on water agar plates (1.3% bacto *agar*) in a laminar flow hood, using forceps previously flamed. A drop of inoculum with an OD comprised between 0.8 and 1.2 (corresponding to about $10^8$ CFU/mL) was placed on each seed (50 uL for maize, 30 uL for wheat, representing approximately $5.10^6$ and $3.10^6$ CFUs for maize and wheat, respectively). For each treatment, 3 plates were prepared with 12 seeds each, arranged as show in on FIG. 2 to insure position uniformity. Plates were sealed with surgical tape, randomized to avoid position effects and placed in a growth chamber set at 22° C., 60% relative humidity, in the dark for four days. After four days, a picture of each plate was taken and the root length of each seedling was measured using the imaging software ImageJ. The percentage difference between the treated plants and the mock-treated (R2A control) was then calculated. For growth under salt stress, the water agar plates were supplemented with 100 mM NaCl. For growth under heat stress, the plates were placed at 40° C., 60% humidity after two days of growth, and left for an additional two days.

Seedling Vigor Assays Under Normal and Stressed Conditions on Filter Paper

Filter papers were autoclaved and placed into Petri dishes, and then presoaked with treatment solutions. To simulate normal conditions, 3-4 mL sterile water was added to the filters. Drought and saline stresses were induced by adding 3-4 mL 8% PEG 6000 solution or 50 or 100 mM NaCl to the filter papers. Surface sterilized seeds were incubated in bacterial inocula for at least one hour prior to plating. Nine seeds were plated in triplicate for each condition tested, including room temperature and heat stress (40° C.) for both normal and saline conditions. During initial stages of the experiment, plates were sealed with parafilm to inhibit evaporative water loss and premature drying of the filter papers. Plates were incubated in the dark at room temperature for two days following which heat treatment plates were shifted to 40° C. for 4-6 days. Parafilm was removed from all plates after 3-5 days. After 5-8 days, seedlings were scored by manually measuring root length for corn and shoot length for wheat and recording the mass of pooled seedlings from individual replicates.

Experimental Results

Plant vigor and improved stress resilience can be surrogates for determining the presence of endophytes within the plant. These can be measured in germination assays to determine whether this particular plant phenotype can be used as a surrogate assay. The collection of seed-origin endophytes produced a measurable response in corn (Tables 14a and 14b), and wheat (Table 15a and Table 15b) when inoculated as compared to non-inoculated controls. For example, from 48 bacterial strains, representing 44 OTUs tested in these germination assays, only 2 did not produce a phenotype in any of the measured multiple parameters such as root length, weight, or shoot length in wheat. Germination assays can therefore be used as a surrogate assay for determining the presence of many endophytes that have been inoculated into the plant.

For drought responses in corn it was found that 73% of the strains were showing a positive response in the filter paper assay as measured by root length and weight. In some cases it was possible to see additive effects for stress responses comparing heat, salt and the combination of heat and salt in the same assay, however not always in a cumulative positive response. For vigor in corn 81% of the strains showed a positive effect when tested in filter paper or water agar assays.

The plant phenotypes indicating the presence of the endophyte within the plant are visible by comparing for example the root length, shoot length and weight of the seedling with non-inoculated controls as illustrated by FIGS. 49, 50, 51, and 52.

Individual tests for stress response for corn showed in average 57% of the strains an increase in weight over control in heat and salt, 51% for heat-salt and 40% for drought on weight gain. For wheat under salt conditions 54% of the strains produced an effect on root length, 77% of the strains a shoot length effect and 50% a weight gain. Drought tests were scored for shoot length and weight with a 59% of the strains showing increase in shoot length and 43% weight increase.

Table 14. Systematic Assessment of Effects of Seed-Origin Microbes on Corn Seed Vigor Under Normal and Stressed Conditions.

TABLE 14(a)

Assay for seedling vigor in water agar conditions

| | | Corn cultivar A | | Corn-organic |
| | | Weight | Root length | Root Length |
| Strain | OTU# | Normal | Normal | normal | salt |
| --- | --- | --- | --- | --- | --- |
| SYM00002 | 66 | | | 2 | 2 |
| SYM00011 | 2 | | | — | 1 |
| SYM00012 | 55 | | | 2 | 2 |
| SYM00017c | 45 | | 1 | 3 | — |
| SYM00028 | 18 | | | 2 | |
| SYM00049 | 7 | 2 | 1 | 3 | 1 |
| SYM00052 | 18 | | | 1 | — |
| SYM00057b | 37 | | | 3 | 2 |
| SYM00060 | 67 | | | 1 | |
| SYM00064a | 10 | | | 2 | 2 |
| SYM00071 | 76 | | | 1 | |
| SYM00075 | 39 | 2 | | — | — |
| SYM00090 | 62 | | | — | 1 |
| SYM00167 | 3 | | | 1 | 1 |
| SYM00188 | 6 | | 1 | 3 | — |
| SYM00192 | 19 | | | 1 | 2 |
| SYM00199 | 135 | | | 1 | 1 |
| SYM00231 | 46 | | | 2 | — |

Legend:
"—" indicates no significant increase relative to uninoculated control;
"1" = 0-5% increase relative to uninoculated control;
"2" = 5-10% increase relative to uninoculated control;
"3" = >10% increase relative to uninoculated control;

TABLE 14(b)

Assay for seedling vigor on filter paper.

| | | ROOT LENGTH Corn organic Filter paper | | | | | SEEDLING WEIGHT Corn organic Filter paper | | | | |
| Strain | OTU # | normal | heat | salt | heat-salt | drought | normal | heat | salt | heat-salt | drought |
| --- | --- | --- | --- | --- | --- | --- | --- | --- | --- | --- | --- |
| SYM00002 | 66 | 1 | 3 | — | — | 3 | 2 | 3 | 1 | — | 1 |
| SYM00011 | 2 | | | | | 2 | — | — | — | — | 2 |
| SYM00012 | 55 | — | 1 | — | — | — | 2 | 2 | — | 2 | — |
| SYM00017c | 45 | 1 | — | 3 | 2 | 2 | — | 1 | 1 | 2 | — |
| SYM00028 | 18 | — | — | — | — | 3 | 1 | — | 2 | 3 | — |

TABLE 14(b)-continued

Assay for seedling vigor on filter paper.

| | | ROOT LENGTH Corn organic Filter paper | | | | | SEEDLING WEIGHT Corn organic Filter paper | | | | |
|---|---|---|---|---|---|---|---|---|---|---|---|
| Strain | OTU # | normal | heat | salt | heat-salt | drought | normal | heat | salt | heat-salt | drought |
| SYM00033 | 0 | — | 1 | 3 | 2 | 2 | 1 | 3 | — | 2 | — |
| SYM00049 | 7 | 1 | 3 | 1 | 2 | 1 | — | — | — | 1 | — |
| SYM00052 | 18 | | | | | 2 | — | — | — | — | 1 |
| SYM00057b | 37 | 1 | 1 | — | 1 | 1 | 1 | 3 | 1 | 1 | 1 |
| SYM00071 | 76 | — | 1 | 2 | 3 | — | 2 | 1 | 2 | 3 | — |
| SYM00075 | 39 | | — | — | — | — | — | — | — | — | 3 |
| SYM00090 | 62 | 2 | 2 | 2 | — | 1 | 3 | 3 | 1 | 1 | — |
| SYM00102 | 38 | — | 2 | 3 | 3 | — | — | 1 | — | 3 | — |
| SYM00107 | 59 | — | 1 | — | — | — | 1 | — | — | 3 | 1 |
| SYM00167 | 3 | 2 | 2 | 1 | 3 | 1 | 1 | 3 | — | 2 | — |
| SYM00172 | 146 | — | — | — | 1 | — | — | — | — | — | — |
| SYM00188 | 6 | — | 1 | 2 | — | — | 1 | 2 | 1 | 3 | — |
| SYM00192 | 19 | — | 2 | — | 3 | — | 1 | 2 | 1 | 3 | — |
| SYM00199 | 135 | — | 3 | — | 3 | — | 1 | 3 | 1 | 3 | — |
| SYM00218 | 41 | | | | | | — | — | 1 | — | 3 |
| SYM00231 | 46 | | | | | | — | — | — | — | 1 |
| SYM00508 | 196 | — | — | — | — | — | 1 | — | — | — | — |
| SYM00547 | 13 | 2 | 1 | 3 | — | 1 | 1 | — | — | — | 1 |
| SYM00554 | 53 | — | 3 | — | 3 | — | — | 2 | — | 3 | — |
| SYM00589 | 31 | — | 2 | 3 | 3 | — | 1 | 3 | 1 | 3 | — |
| SYM00595 | 12 | 1 | 3 | 2 | 2 | — | 1 | 3 | 1 | 3 | — |
| SYM00596 | 9 | 1 | 3 | 3 | 3 | 1 | — | 3 | — | 3 | — |
| SYM00660 | 1 | — | 2 | 1 | 1 | 2 | — | 2 | — | — | 2 |
| SYM00713 | 84 | — | — | — | — | 2 | — | — | — | — | — |
| SYM00775 | 30 | — | — | 3 | — | — | 2 | 2 | — | 3 | 2 |
| SYM00940 | 83 | — | — | — | — | 1 | 1 | 1 | — | — | 1 |
| SYM00967 | 8 | — | — | 3 | — | 3 | 1 | 1 | 1 | — | 1 |
| SYM00975 | 51 | 2 | — | 3 | — | 3 | 1 | 1 | — | — | 2 |
| SYM00991 | 36 | — | — | — | 3 | — | 1 | — | — | — | 1 |
| SYM00992 | 126 | 1 | — | — | — | 3 | — | — | — | — | — |

Table 15. Wheat Stress/Vigor Test

TABLE 15(a)

Wheat seedling vigor assessment using water agar assay.

| | | Root Length Wheat Briggs Water-agar | | |
|---|---|---|---|---|
| Strain | OTU# | Normal | Heat | Salt |
| SYM00002 | 66 | 3 | — | 3 |
| SYM00011 | 2 | 3 | 3 | 3 |
| SYM00012 | 55 | 3 | 1 | 3 |
| SYM00015 | 29 | — | 1 | — |
| SYM00016b | 25 | 2 | 3 | 3 |
| SYM00017c | 45 | 3 | 2 | 3 |
| SYM00021 | 29 | 3 | — | — |
| SYM00028 | 18 | 3 | — | 2 |
| SYM00033 | 0 | 3 | — | 3 |
| SYM00046 | 56 | 3 | | |
| SYM00049 | 7 | 3 | 2 | 2 |
| SYM00052 | 18 | 1 | — | 3 |
| SYM00057b | 37 | 3 | 3 | 3 |
| SYM00060 | 67 | 2 | — | — |
| SYM00063 | 134 | 1 | — | — |
| SYM00064a | 10 | 3 | — | — |
| SYM00071 | 76 | 3 | — | — |
| SYM00075 | 39 | 3 | — | — |
| SYM00090 | 62 | 3 | 2 | 1 |
| SYM00102 | 38 | 2 | — | — |
| SYM00107 | 59 | 2 | 3 | — |
| SYM00167 | 3 | 3 | — | 3 |
| SYM00168 | 45 | 3 | — | 1 |
| SYM00183 | 10 | 3 | — | — |
| SYM00188 | 6 | 1 | — | — |
| SYM00192 | 19 | 3 | 1 | — |
| SYM00199 | 135 | 3 | 1 | 3 |

TABLE 15(a)-continued

Wheat seedling vigor assessment using water agar assay.

| | | Root Length Wheat Briggs Water-agar | | |
|---|---|---|---|---|
| Strain | OTU# | Normal | Heat | Salt |
| SYM00218 | 41 | 3 | 1 | — |
| SYM00508 | 196 | 3 | 3 | 1 |
| SYM00538A | 172 | 1 | — | 1 |
| SYM00547 | 13 | 2 | 3 | 2 |
| SYM00589 | 31 | — | 3 | 1 |
| SYM00595 | 12 | — | 3 | — |
| SYM00596 | 9 | 1 | 3 | 1 |
| SYM00660 | 1 | — | — | 2 |
| SYM00713 | 84 | 2 | — | 1 |
| SYM00775 | 30 | — | 2 | — |
| SYM00940 | 83 | — | 1 | — |
| SYM00965 | 82 | 2 | — | 1 |
| SYM00967 | 8 | 2 | 3 | 3 |
| SYM00975 | 51 | 1 | — | 2 |
| SYM00992 | 126 | — | — | 3 |

Legend:

"—" indicates no significant increase relative to uninoculated control;

"1" = 0-5% increase relative to uninoculated control;

"2" = 5-10% increase relative to uninoculated control;

"3" = >10% increase relative to uninoculated control

TABLE 15(b)

Wheat seedling vigor using filter paper assay.

WHEAT BRIGGS FILTER PAPER

| | | Shoot Length | | | Weight | | |
|---|---|---|---|---|---|---|---|
| Strain | OTU# | Normal | Salt | Drought | Normal | Salt | Drought |
| SYM00002 | 66 | — | 1 | — | — | 2 | — |
| SYM00011 | 2 | 3 | 1 | 3 | 3 | — | 2 |
| SYM00012 | 55 | — | 2 | 3 | 2 | — | 1 |
| SYM00016b | 25 | | | | | | |
| SYM00017c | 45 | — | 1 | — | — | 1 | 2 |
| SYM00028 | 18 | — | 3 | 3 | — | 3 | 3 |
| SYM00033 | 0 | 3 | 1 | 2 | — | — | 1 |
| SYM00049 | 7 | 3 | — | 3 | 2 | — | 2 |
| SYM00052 | 18 | 1 | — | 1 | 3 | — | — |
| SYM00057b | 37 | 3 | 3 | 1 | 2 | — | 3 |
| SYM00064a | 10 | — | 2 | 2 | — | — | — |
| SYM00071 | 76 | 2 | 3 | 3 | — | 3 | 1 |
| SYM00075 | 39 | — | 1 | 3 | — | — | 3 |
| SYM00090 | 62 | — | — | 3 | — | — | 3 |
| SYM00102 | 38 | — | 3 | 3 | 2 | 3 | — |
| SYM00107 | 59 | 1 | 3 | 3 | 2 | 3 | 3 |
| SYM00167 | 3 | 2 | 2 | 1 | — | — | 2 |
| SYM00168 | 45 | | | | | | |
| SYM00172 | 146 | | | — | | | 3 |
| SYM00188 | 6 | 1 | 3 | — | — | 3 | — |
| SYM00192 | 19 | — | 3 | — | 2 | 3 | — |
| SYM00199 | 135 | — | — | 1 | 2 | — | — |
| SYM00218 | 41 | — | 2 | 3 | 3 | — | 3 |
| SYM00231 | 46 | — | — | 3 | 3 | 3 | 3 |
| SYM00508 | 196 | — | 3 | — | — | 2 | — |
| SYM00538A | 172 | | | | | | |
| SYM00547 | 13 | | | 1 | | | — |
| SYM00554 | 53 | — | 3 | — | — | 3 | — |
| SYM00589 | 31 | — | — | — | — | — | — |
| SYM00595 | 12 | 1 | 3 | 3 | 2 | 3 | — |
| SYM00596 | 9 | 1 | 3 | 3 | 1 | 3 | 2 |
| SYM00660 | 1 | | | 3 | | | — |
| SYM00713 | 84 | | | 1 | | | — |
| SYM00965 | 82 | | | | | | |
| SYM00967 | 8 | | | — | | | — |
| SYM00975 | 51 | | | — | | | — |
| SYM00992 | 126 | | | — | | | — |

Legend:
"—" indicates no increase relative to uninoculated control;
"1" = 0-5% increase;
"2" = 5-10% increase;
"3" = >10% increase Growth Test of Inoculated Plants in Magenta Boxes Representative endophytes isolated from seeds as described herein were tested for their ability to promote plant growth under normal and stressed conditions by inoculating maize seeds with those endophytes and growing them inside Conviron Growth chambers (Conviron Corp., Asheville, N.C.) on double-decker Magenta boxes essentially as described in Rodriguez et al. (2008), which is incorporated herein by reference in its entirety. Briefly, the double-deckers were made by drilling a hole 8 mm in diameter in the center of a GA-7 plant culture vessel (Magenta boxes, Sigma, St. Louis), top-knotting and weaving through a 14 cm length of cotton rope to the bottom chamber to act as a wick and adding a defined amount of playground sand in the upper chamber. Peter's 20:20:20 plant nutrient solution (Peters Fertilizer Co., Fogelsville, Pa.) is added to the bottom chamber and a tight-fitting lid is added to the top and the whole system autoclaved and sterilized prior to planting with not-inoculated or endophyte-treated seeds.

Maize seeds were surface sterilized with chlorine gas as described herein. Sterilized maize seeds were soaked for one hour on the appropriate bacterial culture before planting. Each bacterial culture was grown on a shaking incubator 20% Tryptic soy broth (TSB) until reaching ~0.5 optical density, measured at 600 nm wavelength. Non-inoculated controls were soaked on sterile 20% TSB. Three seeds were planted on each double-decker Magenta box and three boxes were used per treatment (endophytic bacteria×environmental condition). The double-deckers were placed inside a Conviron Growth chamber with a setting of 60% humidity and kept in the dark for four days, until they started germinating. Upon germination, plants were grown in a cycle of light (~400 mE×m^-2×s^-1) for 14 hrs. and dark for 10 hrs. When the leaves were fully expanded, approximately 8 days after seeding, the plants were assigned to one of 3 chambers were conditions were as follows: for Control conditions, plants were kept at 22° C.; for cold, plants were subjected to 5° C. during the light part of the daily cycle and near zero degrees during the dark part; for drought, the plants were maintained in the control chamber, but the liquid from the lower part of the double decker was emptied and the soil was allowed to dry; for heat conditions, the light intensity was set to a maximum of ~600 mE×m^-2×s^-1, while the temperature was set to 40° C. for 12 hrs. out of the 14 hrs. of light and 45 degrees during the two hrs. around noon, during the dark cycle the temperature was set to 30° C. The air humidity was maintained at 60% in all chambers. The conditions were maintained for one week at the end of which conductance was measured using an SC-1 Leaf Porometer (Decagon Devices Inc., Pullman, Wash.) in the plants maintained under control and drought conditions and all the plants were harvested, photographed and dried in a convention oven at 45° C. to estimate dried biomass. Shoot and root lengths were measured digitally using the software ImageJ version 1.48u4 (Rasband http://imagej.nih.gov).

Average measurements were compared against those for uninoculated controls for each treatment. The results obtained with the water agar assay are summarized in Table 16. The presence of certain bacterial endophytes was indicated by the plant showing significant growth improvement under normal and/or stressed conditions in maize. Notably, growth improvement was seen when strain SYM90 was present in the plant, under normal, drought and cold conditions, mainly in the form of increased root length. Strains SYM00183, SYM00015, SYM00167 and SYM00168 also increased root length under drought conditions relative to non-inoculated controls.

Testing for biomass under cold conditions also appears to be a good surrogate assay for determining the presence of an endophyte in a plant, as almost all the endophytic bacteria tested provided increase gain in biomass under cold conditions. The magnitude of the difference in the conductance between normal conditions and drought conditions was significantly larger in the plants inoculated with SYM231 relative to the non-inoculated controls.

TABLE 16

Summary of results of testing synthetic combinations of seed-origin endophytes and corn in plant growth tests on Magenta boxes.

| | | Plant vigor and stress resilience in Corn | | |
|---|---|---|---|---|
| | | Root length | | |
| Strain | OTU# | normal | drought | cold |
| SYM00090 | 62 | 2 | 3 | 3 |
| SYM00016b | 25 | — | — | — |
| SYM00231 | 46 | — | 2 | 1 |

TABLE 16-continued

Summary of results of testing synthetic combinations of seed-origin endophytes and corn in plant growth tests on Magenta boxes.

| | | Plant vigor and stress resilience in Corn | | |
|---|---|---|---|---|
| | | Root length | | |
| Strain | OTU# | normal | drought | cold |
| SYM00183 | 10 | 3 | 3 | 2 |
| SYM00015 | 29 | 3 | 3 | — |
| SYM00167 | 3 | 2 | 2 | — |
| SYM00168 | 45 | 2 | 3 | 1 |

Legend:
"—" indicates no significant increase relative to uninoculated control;
"1" = 0-5% increase relative to uninoculated control;
"2" = 5-10% increase relative to uninoculated control;
"3" = >10% increase relative to uninoculated control.

Dose Response

The initial experiments described above were allowed us to determine whether a particular assay was a good surrogate for determining whether the microbe was present in the plant, by looking at certain traits in the colonized plant. We next sought to determine the amount of the microbe that is necessary to treat a plant in order to have a useful bioreactor. In this example, selected microbial cultures were diluted to $OD_{600}$ of 1.0, 0.1 and 0.01 (approximately $10^8$, $10^7$, $10^6$ CFUs/mL respectively) and applied onto wheat seeds (Briggs) using the water agar assay previously described.

SYM00011, SYM00033 and SYM00057B cultures were grown from a single colony in 5 mL of liquid R2A medium at room temperature on a shaker to stationary phase. The absorbance at 600 nm was measured and adjusted to an $OD_{600}$ of 1.0 (~$10^8$ CFUs/mL) in R2A media. Two additional dilutions at OD 0.1 and 0.01 (~$10^7$ and $10^6$ CFUs/mL respectively) were prepared by diluting the initial inoculum 10 and 100 times, again in R2A media.

Wheat seeds (Briggs) were sterilized overnight with chlorine gas and placed on water agar plates as described above. A 30 µL drop of inoculum was placed on each seed, representing approximately $3.0\times10^6$, $3.0\times10^5$ and $3.0\times10^4$ CFUs per seed for OD1, OD0.1 and OD0.01 inoculums, respectively. For each treatment, 3 plates were prepared with 12 seeds each. Plates were sealed with surgical tape, randomized to avoid position effects and placed in a growth chamber set at 22° C., 60% relative humidity, in the dark for four days. After four days, a picture of each plate was taken and the root length of each seedling was measured using the imaging software ImageJ (NIH). The percentage difference between the treated plants and the mock-treated (R2A control) was then calculated.

All doses of the microbes at different concentration provided an increase in root length over the mock-treated controls as shown in FIG. 53. The optimal dose of microbes to confer a growth benefit to wheat varied for SYM00011, SYM00033 and SYM00057B. While this may or may not also be the optimal dose for an endophyte to be stored and propagated inside a plant bioreactor, this dose determination is useful for knowing the minimum dose that can be seen in this surrogate assay. For SYM00011, we observed a positive correlation between the bacterial concentration of the inoculum and the growth benefits conferred to the plant, with ~$3.0\times10^6$ CFUs/seed (30 µL, of $OD_{600}$ of 1.0) being the most effective bacterial amount with a 35% increase in growth. For SYM00057B, plants treated with all three doses had similar root lengths, with the least concentrated inoculum ($3\times10^4$ CFUs/seed), being the most effective amount, suggesting saturation at a lower concentration. Similarly, all three concentrations of SYM00033 provided similar benefits, also suggesting saturation at $3\times10^4$ CFU/seed.

Example 9

Proteomic Analysis of Inoculated Plants

As shown in some of the earlier examples, plant traits may be used as surrogate markers of the presence of endophytic microbes. Changes in the levels of proteins within the plant may also be used as a surrogate to determine the presense of endophytic microbes within a plant bioreactor. In order to explore the pathways augmented or otherwise altered in a plant bioreactor, we performed proteomic analysis on extracts of wheat and corn plants grown on water agar. Sterilized wheat and corn seeds were either mock-inoculated with R2A medium, or inoculated with selected endophytes SYM00011, SYM00016, SYM00057B, SYM00218, using conditions previously described. The seeds were subjected to the growth parameters as summarized below.

| Sample # | Crop | Test | Condition |
|---|---|---|---|
| 1 | Wheat (Briggs) | R2A (mock control) | Normal |
| 2 | Wheat (Briggs) | SYM00218 | Normal |
| 3 | Wheat (Briggs) | R2A (mock control) | Heat |
| 4 | Wheat (Briggs) | SYM00011 | Heat |
| 5 | Wheat (Briggs) | SYM00016 | Heat |
| 6 | Wheat (Briggs) | SYM00057B | Heat |
| 7 | Corn (40R73) | R2A (mock control) | Normal |
| 8 | Corn (40R73) | SYM00057B | Normal |

Sample Collection:

After 4 days of growth, 12 whole seedlings (including roots, seeds and hypocotyls) per treatment were collected in a 50 mL falcon tube using sterile forceps and immediately snap-frozen in liquid nitrogen to minimize protein degradation and proteomic changes during sample collection (such as wound responses from using the forceps). The frozen samples were then homogenized using a pestle and mortar previously cooled in liquid nitrogen and transferred to a 15 mL falcon tube on dry ice. The homogenized samples were stored at −80° C. until further processing.

Sample Preparation 1 mL of 5% SDS 1 mM DTT was added to 1 mL of homogenized tissue and the samples were boiled for 5 mins. The samples were cooled on ice and 2 mL of 8M urea solution was added. The samples were spun for 20 mins. at 14,000 rpm and the soluble phase recovered. A 25% volume of 100% TCA solution was added to the soluble phase, left on ice for 20 mins. and centrifuged for 10 mins. at 14,000 rpm. The protein pellet was washed twice with ice-cold acetone and solubilized in 125 µL 0.2M NaOH and neutralized with 125 µL of 1M Tris-Cl pH 8.0. Protein solutions were diluted in THE (50 mM Tris-Cl pH8.0, 100 mM NaCl, 1 mM EDTA) buffer. RapiGest SF reagent (Waters Corp., Milford, Mass.) was added to the mix to a final concentration of 0.1% and samples were boiled for 5 min. TCEP (Tris (2-carboxyethyl) phosphine) was added to 1 mM (final concentration) and the samples were incubated at 37° C. for 30 min. Subsequently, the samples were carboxymethylated with 0.5 mg/ml of iodoacetamide for 30 min at 37° C. followed by neutralization with 2 mM TCEP (final concentration). Proteins samples prepared as above were digested with trypsin (trypsin:protein ratio—1:50) overnight at 37° C. RapiGest was degraded and removed by treating the samples with 250 mM HCl at 37° C. for 1 h followed by centrifugation at 14,000 rpm for 30 min at 4° C. The soluble fraction was then added to a new tube and the peptides were extracted and desalted using Aspire RP30 desalting columns (Thermo Scientific). The trypsinized samples were labeled with isobaric tags (iTRAQ, ABSCIEX, Ross et al 2004), where each sample was labeled with a specific tag to its peptides.

Mass Spectrometry Analysis

Each set of experiments (samples 1 to 6; samples 7 and 8) was then pooled and fractionated using high pH reverse phase chromatography (HPRP-Xterra C18 reverse phase, 4.6 mm×10 mm 5 μm particle (Waters)). The chromatography conditions were as follows: the column was heated to 37° C. and a linear gradient from 5-35% B (Buffer A-20 mM ammonium formate pH10 aqueous, Buffer B-20 mM ammonium formate pH10 in 80% ACN-water) was applied for 80 min at 0.5 ml/min flow rate. A total of 30 fractions of 0.5 ml volume where collected for LC-MS/MS analysis. Each of these fractions was analyzed by high-pressure liquid chromatography (HPLC) coupled with tandem mass spectroscopy (LC-MS/MS) using nano-spray ionization. The nano-spray ionization experiments were performed using a TripleTof 5600 hybrid mass spectrometer (AB SCIEX Concord, Ontario, Canada)) interfaced with nano-scale reversed-phase HPLC (Tempo, Applied Biosystems (Life Technologies), CA, USA) using a 10 cm-180 micron ID glass capillary packed with 5 μm C18 Zorbax™ beads (Agilent Technologies, Santa Clara, Calif.). Peptides were eluted from the C18 column into the mass spectrometer using a linear gradient (5-30%) of ACN (Acetonitrile) at a flow rate of 550 μl/min for 100 min. The buffers used to create the ACN gradient were: Buffer A (98% $H_2O$, 2% ACN, 0.2% formic acid, and 0.005% TFA) and Buffer B (100% ACN, 0.2% formic acid, and 0.005% TFA). MS/MS data were acquired in a data-dependent manner in which the MS1 data was acquired for 250 ms at m/z of 400 to 1250 Da and the MS/MS data was acquired from m/z of 50 to 2,000 Da. For Independent data acquisition (IDA) parameters MS1-TOF 250 ms, followed by 50 MS2 events of 25 ms each. The IDA criteria, over 200 counts threshold, charge state +2-4 with 4 s exclusion. Finally, the collected data were analyzed using Protein Pilot 4.0 (AB SCIEX) for peptide identifications and quantification.

Results:

The proteomics analysis of wheat inoculated with endophytic bacteria (SYM11, SYM16B and SYM57B) grown under heat stress and maize inoculated with SYM57B grown under normal conditions revealed three major pathways augmented or otherwise modified within the plant bioreactor: growth promotion, resistance against oxidative stress and mechanisms involved in symbiosis enhancement (Table 17 and Table 18).

TABLE 17

Proteins showing differential levels of expression under heat stress in endophyte-inoculated wheat (var. Briggs) seedlings relative to not-inoculated control seedlings.
UP-REGULATED PROTEINS IN RESPONSE TO ENDOPHYTIC BACTERIA

| | Growth promotion | | | Ratio Treatment/Control | |
| --- | --- | --- | --- | --- | --- |
| Accession number | Gene name | Pathway | SYM-00011 | SYM-00016B | SYM-00057B |
| gi\|474293349 | Acid beta-fructofuranosidase | mobilization of sucrose | 0.5-1 Fold | 1-2 Fold | 1-2 Fold |
| gi\|473798701 | ATP synthase subunit beta, mitochondrial | ATP synthesis | 1-2 Fold | 1-2 Fold | |
| gi\|473945263 | Fructan 1-exohydrolase | mobilization of fructans | | | 1-2 Fold |
| gi\|473798921 | Glutamine synthetase cytosolic isozyme 1-2 | Amino acid biosynthesis | | 1-2 Fold | 1-2 Fold |
| gi\|474427549 | Dynamin-related protein 1E | Cell division | 1-2 Fold | 1-2 Fold | 1-2 Fold |
| gi\|474154210 | Histone H1 | Cell division | 1-2 Fold | 1-2 Fold | 1-2 Fold |
| gi\|474396419 | Histone H1 | Cell division | | 1-2 Fold | 1-2 Fold |
| gi\|474315053 | Histone H2A | Cell division | 1-2 Fold | 1-2 Fold | >2 Fold |
| gi\|474114390 | Histone H2A | Cell division | | | 1-2 Fold |
| gi\|474408930 | Histone H2A.1 | Cell division | 1-2 Fold | | >2 Fold |
| gi\|474247555 | Protein H2A.7 | Cell division | 1-2 Fold | 0.5-1 Fold | |
| gi\|474400621 | Histone H4 | Cell division | 1-2 Fold | | 1-2 Fold |
| gi\|474160133 | Serine carboxypeptidase-like protein | Amino acid release | 1-2 Fold | 1-2 Fold | 1-2 Fold |
| gi\|474397165 | Serine carboxypeptidase-like 51 | Amino acid release | >2 Fold | 1-2 Fold | |
| gi\|474449933 | Pectinesterase 1 | Cell wall remodeling | 1-2 Fold | | >2 Fold |
| gi\|474193958 | Peptidyl-prolyl cis-trans isomerase CYP40 | Juvenile phase of vegetative development | 1-2 Fold | >2 Fold | >2 Fold |
| gi\|473956589 | Ribonucleoside-diphosphate reductase | DNA synthesis | 0.1-0.5 Fold | 0.1-0.5 Fold | >10 Fold |
| gi\|474326915 | Villin-4 | Cell elongation | >2 Fold | >10 Fold | >2 Fold |
| gi\|474156626 | Glutenin, low molecular weight subunit | Protein storage - affected by heat | 1-2 Fold | 1-2 Fold | |
| | Resistance against abiotic stress | | | | |
| Accession number | Gene name | Function | SYM-00011 | SYM-00016B | SYM-00057B |
| gi\|474449933 | Pectinesterase 1 | Resistance to drought | 1-2 Fold | | >2 Fold |
| gi\|474381202 | Peroxiredoxin Q, chloroplastic | Resistance to oxidative stress | 0.5-1 Fold | 0.5-1 Fold | >2 Fold |

TABLE 17-continued

Proteins showing differential levels of expression under heat stress in endophyte-inoculated wheat (var. Briggs) seedlings relative to not-inoculated control seedlings.

UP-REGULATED PROTEINS IN RESPONSE TO ENDOPHYTIC BACTERIA

| | | | | | |
|---|---|---|---|---|---|
| gi\|474299547 | Glutathione S-transferase DHAR3, chloroplastic | Resistance to oxidative stress | 1-2 Fold | 1-2 Fold | >2 Fold |
| gi\|474276683 | Peroxidase 12 | Resistance to oxidative stress | 1-2 Fold | 1-2 Fold | 1-2 Fold |
| gi\|474414579 | 3-hydroxybenzoate 6-hydroxylase 1 | Degradation of toxic organic compounds | 1-2 Fold | >2 Fold | 1-2 Fold |
| gi\|474323467 | BAHD acyltransferase DCR | Cutin formation - dessication resistance | 1-2 Fold | 1-2 Fold | 0.1-0.5 Fold |
| gi\|473999626 | 5'-methylthioadenosine/S-adenosylhomocysteine nucleosidase | Negative feedback on ethylene production | 0.5-1 Fold | 0.5-1 Fold | 0.5-1 Fold |
| gi\|474326305 | Aldehyde dehydrogenase family 2 member C4 | Controls acetaldehyde accumulation | 0.5-1 Fold | 0.5-1 Fold | 0.5-1 Fold |
| gi\|474041937 | putative protein phosphatase 2C 45 | Regulates ABA signaling | | 0.5-1 Fold | |
| gi\|473894812 | DEAD-box ATP-dependent RNA helicase 40 | mRNA decay and ribosome biogenesis | | 0.1-0.5 Fold | |

Symbiosis enhancement

| Accession number | Gene name | Function | Ratio Treatment/Control | | |
|---|---|---|---|---|---|
| | | | SYM-00011 | SYM-00016B | SYM-00057B |
| gi\|474407144 | Enolase 1 | Glycolisis of sugars required by endophyte | 0.5-1 Fold | 0.5-1 Fold | |
| gi\|474119301 | Protochlorophyllide reductase B, chloroplastic | Affected by symbiosis | | 0.5-1 Fold | |
| gi\|474213532 | Elicitor-responsive protein 1 | Microbe response signaling | 0.5-1 Fold | 0.5-1 Fold | 1-2 Fold |

TABLE 18

Proteins showing differential levels of expression under normal condition in endophyte-inoculated corn (40R73) seedlings relative to not-inoculated control seedlings.

Growth promotion

| Accession number | Gene name | Pathway | SYM-00057B/control |
|---|---|---|---|
| gi\|413950290 | putative peptidyl-prolyl cis-trans isomerase | Organ development | >2-fold |
| gi\|414876902 | ATP-dependent Clp protease proteolytic subunit | Chloroplast component | >2-fold |
| gi\|413948820 | Translation elongation factor Tu isoform 3 | Protein biosynthesis | 1-2 fold |
| gi\|414878150 | Chaperone protein dnaJ 15 | Positive gravitropism | <0.5-fold |
| gi\|413954599 | translation elongation/initiation factor | Embryo development ends seed dormancy | <0.5-fold |

| Accession number | Gene name | Function | SYM-00057B/control |
|---|---|---|---|

Resistance against abiotic stress

| | | | |
|---|---|---|---|
| gi\|414867473 | Glutathione S-transferase GSTU6 | Resistance to oxidative stress | 1-2 fold |
| gi\|414876903 | Calmodulin2 | ABA-induced antioxidant defense | <0.5-fold |
| gi\|413920116 | Ras protein Rab-18 | ABA inducible, accumulates in cold stress | 0.5-1 fold |
| gi\|413926351 | DNA repair protein RAD23-1 isoform 3 | Nucleotide-excision repair | 0.5-1 fold |

Symbiosis enhancement

| | | | |
|---|---|---|---|
| gi\|413920282 | Hydroquinone glucosyltransferase | Upregulated in Rhizobia symbiosis | >10-fold |
| gi\|413939151 | replication factor C subunit 3 | Negative regulation of defense response | >10-fold |
| gi\|413946904 | NEDD8-activating enzyme E1 catalytic subunit | Protein neddylation - microbe response | >10-fold |
| gi\|413951445 | delta3,5-delta2,4-dienoyl-CoA isomerase | Peroxisome component - defense | >10-fold |
| gi\|413925737 | Proteasome subunit alpha type | Response to compatible symbiotic bacteria | >2-fold |
| gi\|413957021 | Ras protein RHN1 | Legume homolog involved in nodulation | >2-fold |

TABLE 18-continued

Proteins showing differential levels of expression under normal condition in endophyte-inoculated corn (40R73) seedlings relative to not-inoculated control seedlings.

| gi|414875813 | Early nodulin 20 | Root nodule formation | >2-fold |
| gi|414886632 | Putative plant regulator RWP-RK family protein | Nodule inception protein | 1-2 fold |
| gi|413955359 | putative metacaspase family protein | Programmed cell death regulation | 0.5-1 fold |
| gi|413920552 | win1 | Defense response to bacteria and fungi | <0.5-fold |
| gi|413948744 | protein brittle-1 | Response to nematodes | <0.5-fold |
| gi|414869634 | Proteasome subunit beta type | Regulation of hypersensitive response | 0.5-1 fold |

Determining the levels of any of the proteins in Table 17 and Table 18 within a plant is another surrogate method of determining the presence of an endophyte.

Example 10

Analysis of Hormone Levels in Inoculated Plants

As shown in some of the earlier examples, plant traits and protein levels may be used as surrogate markers of the presence of endophytic microbes. In order to explore the possibility that hormone levels may also be used as surrogate markers of the presence of endophytic microbes within a plant bioreactor, a metabolomic analysis was performed of 12 phytohormones (indole-3-carboxylic acid, trans-zeatin, abscisic acid, phaseic acid, indole-3-acetic acid, indole-3-butyric acid, indole-3-acrylic acid, jasmonic acid, jasmonic acid methyl ester, dihydrophaseic acid, gibberellin A3, salicylic acid) in wheat and corn plants grown on water agar under normal condition and inoculated by SYM57B or a mix of selected endophytes (see below). The mixes of endophytes inoculums were obtained by mixing equal volume of the different bacterial cultures.

| Crop | Treatment |
| --- | --- |
| Wheat (Briggs) | R2A (mock control) |
| Wheat (Briggs) | SYM57B |
| Wheat (Briggs) | Mix (SYM11 + SYM17C + SYM49 + SYM57B) |
| Corn (40R73) | R2A (mock control) |
| Corn (40R73) | SYM57B |
| Corn (40R73) | Mix (SYM17C + SYM49 + SYM57B + SYM188) |

Samples Analyzed for Plant Hormone Profiling
Methods
Sample Preparation 4-day old whole wheat and corn seedlings (including roots, seed and hypocotyl) were finely ground in liquid nitrogen by mortar and pestle then aliquoted into 1.5 mL microcentrifuge tubes and weighed. Phytohormones were extracted from ground sprouts using a protein precipitation protocol where cold extraction solvent (80% aqueous methanol with 1% acetic acid) containing internal standards was added to the finely ground plant material (400 µL solvent for every 100 mg ground plant tissue). Samples were kept on ice during the addition of extraction solvent. Samples were then vortexed for 60 min at medium-high speed at 4° C., then centrifuged for 15 min at 13,000 g at 4° C. The resultant supernatant was removed and analyzed by LC-MS/MS.

LC-MS/MS

Phytohormones were chromatographically separated using a Waters nanoAcquity UPLC system on a Waters Atlantis dC18 column (3 µM, 300 µM×150 mm) held at 40° C. Samples were held at 4° C. in the auto-sampler. Water (buffer A) and acetonitrile (buffer B), both with 0.1% formic acid, were used as buffers. The flow rate was 11.5 µL/min and injection volume 1 µL. Each sample was injected twice and hormone levels averaged. Phytohormones were analyzed by selected reaction monitoring (SRM) on a Waters Xevo TQ-S mass spectrometer in both negative and positive ion modes. The UPLC gradient was as follows: time (t)=0 min, 10% B; t=0.5 min, 10% B; t=5.5 min, 95% B; t=7.5 min, 95% B; t=8 min, 10% B. The column was equilibrated for three minutes before each injection.

Results

Several plant hormones, including indole-3-carboxylic acid, trans-zeatin, abscisic acid, phaseic acid and indole-3-acetic acid, can be assayed to determine the presence of an endophytes that has been inoculated into a plant bioreactor. In addition, inoculating multiple endophytes into a plant bioreactor can further modify the plant hormone profiling of inoculated plants. In particular, the level of abscisic acid and indole-3-carboxylic acid, the decarboxylated form of auxin, was augmented by 63% and 98% respectively in corn inoculated with the mixed endophytes.

Example 11

Assessing Plant Bioreactors in the Field

Planting and Setup of Populations of Bioreactors in a Field

In addition to the assays described above, determining the phenotype of the plant bioreactor in the field may serve as additional surrogate assays for the presence of an endophyte. The field assay involved testing individual microbial strains and combinations of strains by treating and planting the seeds of a variety of plants (including, but not limited to maize, wheat, cotton, and barley), with one or two varieties or cultivars of each plant tested. The field assay was laid out as a randomized complete block design, with each combination microbial treatment and plant variety replicated six times in the assay.

Field assays were conducted across various geographies including field sites in major producing regions of South Dakota, Nebraska, Saskatchewan and Austria, on both dry and irrigated land to test responses in both well-watered and drought-stressed conditions. Field assays may also be conducted in geographies with hotter growing seasons, where temperatures can reach up to 95° F. for five or more consecutive days, in order to assess responses under heat stress. Field assays may also be conducted in geographies prone to higher levels of microbial, nematode or insect pathogens in order to assess responses under pathogen stress Fertilizer and herbicides are applied according to soil test results and locally recommended practice. Fertilizer may be applied at 25%, 50% or 75% of recommended levels to assess responses under nutrient stress.

For maize, typical field plots were 10'×'40' with 4 evenly spaced rows, seeded at a rate of approximately 34,000 seeds per acre. Each randomized complete block trial included an untreated control and a mock-formulation control, as well as additional untreated border plots on the 40' ends. For wheat, typical field plots were 5'×50' with 7 evenly spaced rows, seeded at a rate of approximately 90 lbs per acre. Each randomized complete block trial included an untreated control and a mock-formulation control.

Measurement of Biomass

Biomass of field plots is assessed by selecting 10 plants per plot for maize or 20 plants per plot for wheat at random from the middle two rows at harvest, removing the plants from the soil and cleaning off any residual soil. Plants are then divided into aerial and root sections and weighed to obtain fresh weight. Plants are then dried in a vacuum oven overnight and weighed again to obtain dry weight.

Measurement of Yield, Grain Moisture, Test Weight

Yield of field plots is measured at the end of the growing season by harvesting the plots with an appropriate harvester. For maize, only the middle two rows are harvested. For wheat, all 7 rows may be harvested, or only the middle 5 may be used. Test weight and moisture of the grain may be recorded by the harvester, or subsamples of the harvested grain may be used for manual test weight assessment and moisture analysis in a DICKEY-john® grain moisture analyzer (Dickey-John Corp., Chatham, Ill.), using parameters recommended by the manufacturer.

Measurement of Emergence & Plant Height

Emergence in the field plots was assessed for wheat by counting the number of emerged plants in the middle 10' section of the middle two rows and reporting the total number plants emerged. Emergence counts were done every four days starting with the day of emergence of the first plants and ending when 50% or more of the plants in the plot had reached Feekes scale 2. Emergence in the field was assessed for maize by doing a full count of all emerged plants in the plot and reporting the number of emerged plants as a percentage of the number of seeds planted in that plot. Two emergence counts were done, one at the emergence of the first plants and a second count five days later.

Emergence of wheat in a field trial on four different days is shown in the top panel of FIG. 54. The numbers reported are an average of emergence counts of 6 replicate plots for each treatment. The presence of the endophytes tested was determined by the fact that they all show improvement in emergence over the untreated control, with SYM00028 showing the greatest improvement.

Emergence of corn in a field trial is shown in the middle panel of FIG. 54 (for a dryland trial) and in the bottom panel FIG. 54 (for an irrigated trial). The numbers are reported as a percent increase over an untreated control and were calculated as an average of emergence counts of 6 replicate plots for each treatment. The improvement in emergence over the untreated control for all SYM strains show the presence of these endophytes within the bioreactor plant.

Measurement of Flowering Time

The day of flowering for a particular plot is recorded when 50% or more of the plants in the plot have reached the flowering stage.

SPAD Measurement

Chlorophyll values, for example, SPAD readings are conducted on wheat by measuring 10 plants per plot at random from the middle two rows. The first measurement is done at flowering, with a second measurement done two weeks later on the same 10 plants in each plot. The SPAD reading is taken on the flag leaf on each plant, for example, as measured with SPAD502 supplied by Minolta Co., Ltd., at approximately three quarters of the leaf length from the leaf base and avoiding the midrib of the leaf. SPAD readings are conducted on maize by measuring 10 plants per plot at random from the middle two rows. The first measurement is done at flowering (VT stage), with a second measurement done two weeks later on the same 10 plants in each plot. The SPAD reading is taken on the topmost leaf under the tassel, approximately 0.5 inch from the edge of the leaf and three quarters of the leaf length from the leaf base.

Stand Count & Lodging Assessment

Stand count and percent lodging are assessed in wheat by counting the total number of tillers and the number of broken stalks in the middle two rows on the day of harvest. Stand count and percent lodging are assessed in maize by counting the number of standing plants and the number of stalks broken below the ear in the middle two rows on the day of harvest.

Example 12

Introducing *Burkholderia phytofirmans* Strain PsJN into Maize Seeds

All of the previous examples showed the possibility of introducing an endophyte into a plant bioreactor by coating the seed of the plant. The following examples look at the possibility of introducing the endophyte by spraying the flower of a plant to obtain internal seed colonization, also called an endoseed. Similarly to plant bioreactors creased by seed treatment, the presence of the endophyte in an endoseed can be determined by looking at the changes in the plant phenotype.

The concept of internal seed colonization with microorganisms according to the present invention was tested with the endophytic bacterium *Burkholderia phytofirmans* stain PsJN and two varieties of maize. Strain PsJN was applied by spraying female flowers with a suspension of $10^8$-$10^9$ CFU $mL^{-1}$. Control seeds were either non-treated or treated with seed coating formulation for the same bacterial strain. Experiments were performed to determine the effects of internally colonized maize seeds ("endoseeds") on offspring plant biomass and vigor as compared to non-treated controls and external application of the same bacterial strain.

Experiment Description

This experiment shows that seeds having microorganisms (especially bacteria) inside them can be produced, and the presence of the endophyte can be determined by assessing changes in plant biomass over controls. A variant of the bacterium *Burkholderia phytofirmans* strain PsJN chromosomally tagged with the β-glucuronidase gene (gusA, reporter gene for detection and monitoring of the strain by color formation) was used as a test strain in to maize cultivars (Peso and Morignon). For this, a series of experiments were performed and the experimental setup was divided into two categories ($1^{st}$ and $2^{nd}$ year experiments): (A) evaluation of strain PsJN colonization potential in different tissues of maize plants (particularly grains), and (B) follow-up evaluation of strain PsJN colonized seed and strain PsJN inoculation (exogenously), which allowed the determination of whether the surrogate assay of plant productivity over control can be used to determine the presence of the endophyte within the plant bioreactor.

Growth of PsJN Strain as Bacterial Inoculum

The bacterial strain was grown by loop-inoculating one single colony in LB broth amended with spectinomycin (100 µg mL$^{-1}$) in 100 mL flasks. The bacterial culture was incubated at 28° C. for 2 days at 180 rpm in a shaking incubator. The bacterial inoculum was applied in two different ways i.e., seed soaking and spraying inoculum at flowering stage. Maize seeds were surface sterilized by dipping for 5 and 3 min in 70% ethanol and NaOCl following 3 washings with sterilized water. There were three treatments, 1) seed inoculation 2) specific spraying of flowers and 3) seed inoculation combined with flower inoculation. Plants grown from seeds treated with sterile culture broth only served as control. For inoculation, seeds of two maize cultivars were dipped for 3-4 hours in bacterial inoculum ($10^8$-$10^9$ CFU mL$^{-1}$). Likewise, bacterial inoculum was specifically sprayed to the female flower when the crop reached flowering stage. Seeds were sown in plastic trays filled with soil and 12 day-old seedlings were transferred into 50 kg soil container (2 plants in each container) under wirehouse conditions.

Endophytic Colonization by PsJN Strain (Particularly Grain Colonization)

Figure 35:
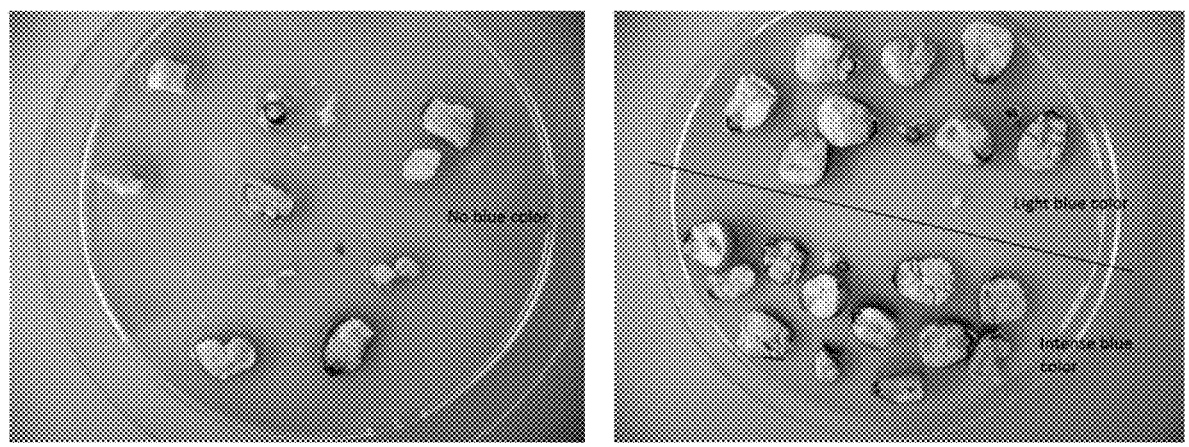
FIG. 35 shows maize colonization by PsJN (harboring expressing beta-glucuronidase) visualized through gus-staining procedure.

The rhizosphere and endophytic colonization of root, stem and leaves by the gusA-labeled variant of *B. phytofirmans* strains PsJN was determined by plate counting using LB plates amended with 5-Bromo-4-chloro-3-indolyl b-D-glucuronide (X-glcA, 50 µg mL$^{-1}$), IPTG (50 µg mL$^{-1}$) and the antibiotic spectinomycin (100 µg mL$^{-1}$). Root, stem and leaf samples were washed, surface sterilized (as described above) and used for PsJN recovery (colonization). For this, samples were crushed in 0.9% saline buffer, subjected to oscillation in a pulsifier for 30 sec and dilution series were spread on agar plates. β-glucuronidase positive cells appear blue on media containing X-glcA. The blue colonies were counted after 3 days of incubation at 30° C. and the original cell number per g plant tissue was calculated. Similarly, PsJN colonization was also observed from different cob parts i.e., sheath, grains and cob interior (see FIG. 35). The identity of the blue colonies was further confirmed by RFLP analysis of the 16S-23S rRNA intergenic spacer region.

Follow-up experiments were performed in the 2$^{nd}$ year to evaluate the (1) viability, activation and colonization ability of strain PsJN colonizing maize seeds; (2) effect of strain PsJN colonized seed on germination and seedling vigor compared to untreated control (plastic tray assay); and (3) effect of strain PsJN colonized seed on plant biomass compared to untreated control (pot trials).

Prior to the plant experiments, PsJN colonized seeds of both cultivars were tested to see whether PsJN cells are present and viable inside. For this purpose, 20 seeds were imbibed in saline buffer for 2-3 days and subsequently crushed in 0.9% saline buffer, shaken for 45 second with a pulsifier and spread in dilutions on LB plates amended with X-glcA, IPTG and spectinomycin.

Bacterial inoculum was prepared as described above and three experiments were performed with four treatments i.e., control, seed inoculation with strain PsJN (exogenously), PsJN colonized seeds (produced in 1$^{st}$ year by spraying), PsJN colonized seed+inoculation.

Seeds (45) were surface sterilized and inoculated as described earlier, and were sown in a plastic tray (30 cm diameter) with three replicates. Data on time to start germination, mean germination time, time to 50% and final germination, germination index and energy, coefficient of uniform germination, and skewness were recorded of PsJN colonized over control.

Two pot experiments were performed to evaluate the performance of PsJN colonized seeds concerning plant biomass production as compared to control. Surface sterilized seeds were directly sown in pots with soil (first pot trial) or alternatively sown in plastic trays, and after 10 days seedlings were transferred to 5 kg pots (2$^{nd}$ pot trial). All plants were harvested after 60 days and data of plant height, number of leaves per plant and root-shoot biomass were recorded. The data were subjected to analyses of variance using SPSS software package version 19 (SPSS Ink, Chicago, Ill.).

Results Experiment A (1$^{st}$ Year): Seed Colonization by Strain PsJN

Figure 1:
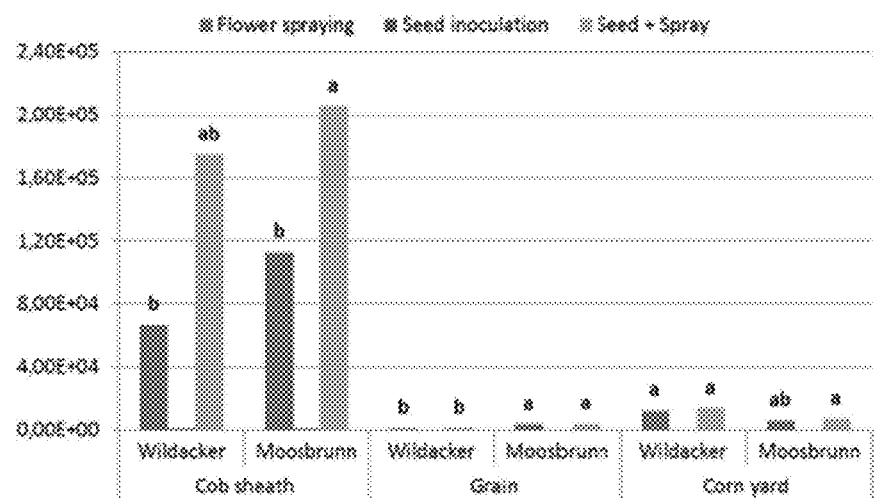
FIG. 1 shows maize seeds and compositions that have been introduced with a desired hormone-producing, phosphate-solubilizing gram-negative bacteria. Specifically, the cob sheath, grain and cob interior show colonization of the proteobacteria *Burkholderia phytofirmans* strain PsJN in maize cvs Peso and Morignon (x-axis shows CFU/g dry weight).

The ability of strain PsJN to colonize maize cobs (cob sheath, cob interior and grains) was analyzed in plants treated by specific flower inoculation (by spraying) only or by seed inoculation (FIG. 1). Only inoculation of flowers resulted in internal colonization of seeds. Internal seed colonization by strain PsJN was observed in both cultivars and both flower inoculation treatments. PsJN cells were detected in maize seeds at viable population densities that ranged from $10^2$-$10^5$ CFU g$^{-1}$ fresh weight. At maturity, PsJN cells were detected within maize seeds at viable population densities that ranged from $10^2$-$10^5$ CFU g$^{-1}$ fresh weight. Strain PsJN was not recovered from plants grown from seeds that were coated with inoculum. After 12 months of storage $10^2$ viable cells per g seeds were still recovered.

Experiment B1 (2$^{nd}$ Year): Viability, Activation and Colonization Ability of Strain PsJN Colonizing Maize Seeds.

Figure 2:
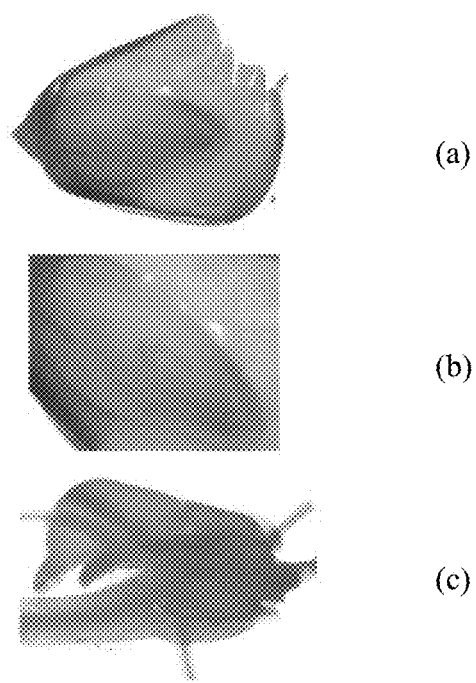
FIG. 2 shows light microscopy images of a mature seed colonized by a desired hormone-producing, phosphate-solubilizing gram-negative proteobacteria. Specifically, *Burkholderia phytofirmans* strain PsJN is engineered with gusA in order to allow its detection with a colorimetric assay. The blue color is due to gusA-marked bacterial cells; strain PsJN is present inside the embryo (a, b) and in radicals (c); PsJN starts moving from embryo to germinated parts (c).
Figure 3:
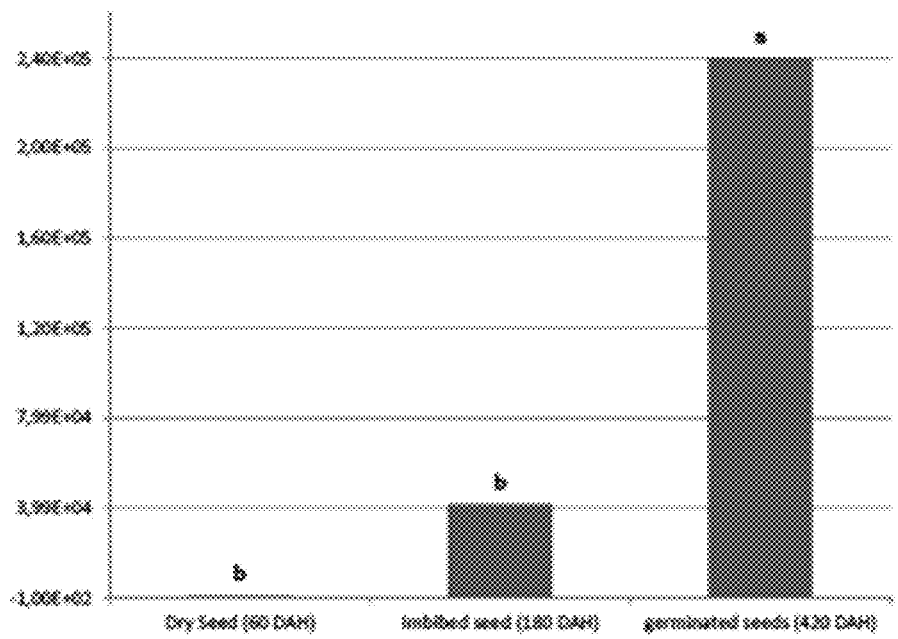
FIG. 3 shows the recovery of a desired hormone-producing, phosphate-solubilizing gram-negative proteobacteria (*Burkholderia phytofirmans* strain PsJN) from the grain interior at different time intervals after harvesting (DAH; Days after harvesting) and storage at room temperature.

PsJN colonized seeds, recovered from the first year experiment were tested to see whether PsJN cells survive inside dormant seed and have the ability to colonize the plants emerging from the seeds. This is very important as it would enable the storage of endophytes within seeds for several months. $10^2$ viable cells were detected in two months old dormant seeds (FIG. 1). Imbibing in saline buffer for 2-3 days activated the 6 month-old seeds and when the seeds began to germinate, PsJN started to proliferate resulting in a recovery of $10^4$ viable cells. Sprouts the emerged from 420 day old seeds were colonized by $10^5$ PsJN cells and the bacteria was found all over the inside the sprouts (FIGS. 2 and 3).

Experiment B2 (2$^{nd}$ Year): Effect of PsJN Colonized Seeds on Germination and Seedling Vigor as Compared to Untreated Control The data summarized in Table 19 and Table 22 revealed that PsJN colonized seeds showed significant improved germination ability. PsJN colonized seeds of both cultivars started to germinate 36-48 hours earlier than the control. PsJN colonized seed showed almost 100% final germination and required less mean germination time as compared to the control seeds. Consequently, the colonized seeds have better germination index as compared to control, indicating the utility of the germination assay as a surrogate assay for determining the presence of the endophyte within the bioreactor plant.

Figure 4:
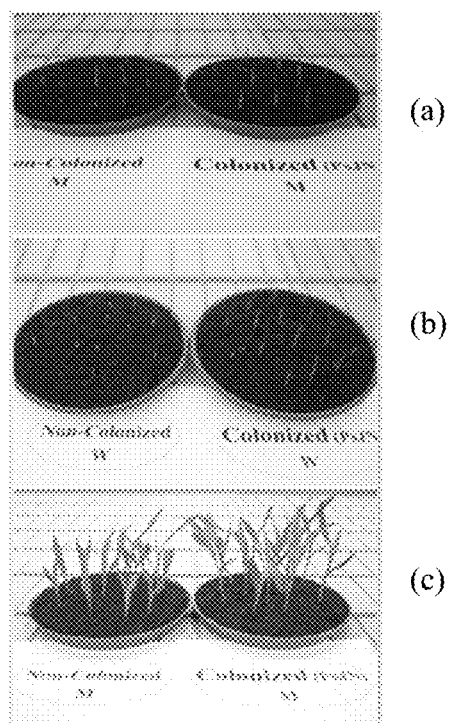
FIG. 4 shows the ability of maize seeds that were generated to comprise the hormone-producing, phosphate-solubilizing gram-negative proteobacteria (*Burkholderia phytofirmans* strain PsJN) to germinate after prolonged storage at room temperature, allowing the further propagation of the microbe (a, b, c).
Figure 5:
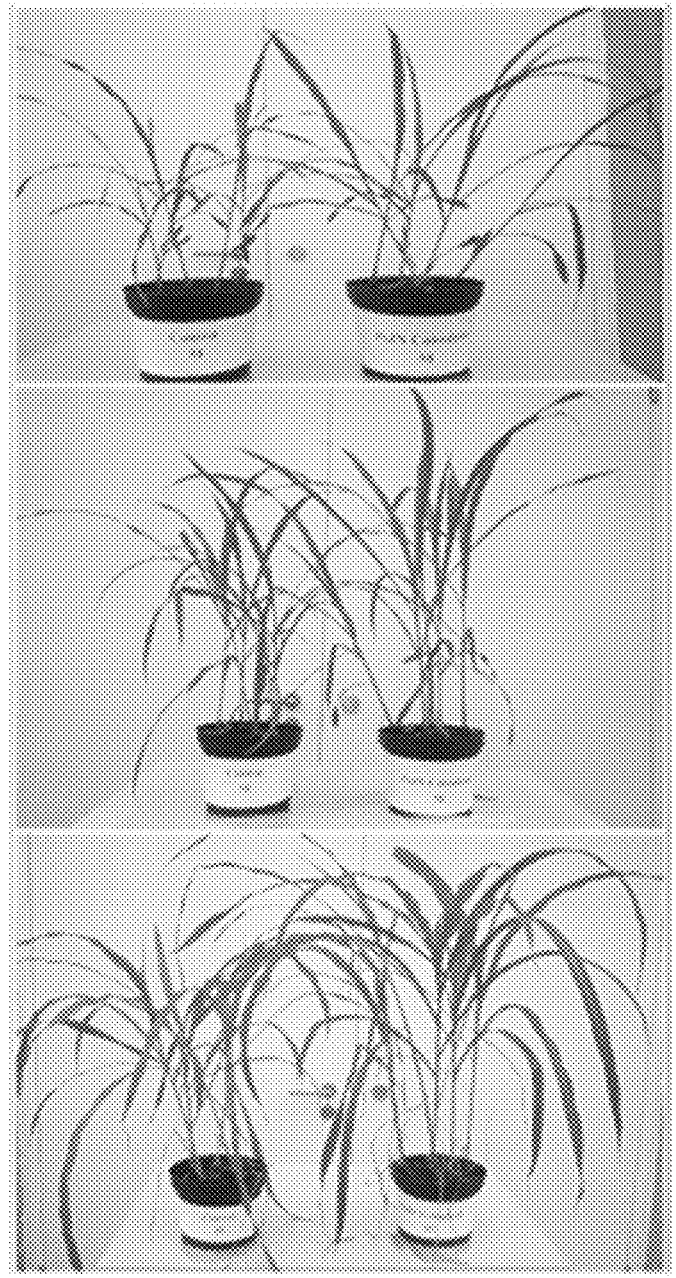
FIG. 5 shows the ability of a desired hormone-producing, phosphate-solubilizing gram-negative proteobacteria (*Burkholderia phytofirmans* strain PsJN) to propagate following germination of maize seeds comprising the microbe that were stored at room temperature for long periods of time (a, b, c; 30, 45, 60 days after sowing).

Moreover PsJN colonized seeds of both cultivars showed significantly higher maize seedling biomass as compared to untreated control seeds (Tables 20 and 23; FIGS. 4 and 5) but non-significantly higher seedling biomass as compared to seeds exogenously inoculated with PsJN. The biomass of the plant bioreactor can therefore be used as another surrogate assay for determining the presence of the endophyte within the bioreactor plant.

Experiment B3 (2$^{nd}$ Year): Effect of PsJN Colonized Seed on Plant Biomass Compared to Untreated Control (Pot Trials)

The data of the pot trials (Table 21 and Table 24) revealed that PsJN colonized maize seeds had a positive effect on plant biomass production comparable to seeds externally coated with PsJN cells with cv Morignon being more responsive than cv Peso in both treatments (Table 21 and Table 24). The PsJN colonized seeds showed 38% increase in plant biomass production and a significant increase in root biomass as compared to the control. Moreover, the number of leaves per plant was higher in plants of PsJN colonized seed as compared to the control.

Conclusions

*Burkholderia phytofirmans* PsJN can be introduced into maize seeds by spraying cells onto flowers.

Seed inoculation only does not allow colonization of maize seeds of the next generation.

Strain PsJN can survive inside maize seeds for at least 12 months when stored in good conditions Seed-colonizing bacterial cells are rapidly activated, proliferate and colonize emerging sprouts during germination Germination and biomass assays (including root biomass) can be useful surrogate assays for determining the presence of the endophyte within the bioreactor plant.

TABLE 19

Comparative performance of PsJN colonized seed and PsJN inoculated seed (exogenously) on germination of maize cv Peso
(Data presented is the average of n = 3 independent replicates.)

| Treatment | Time to Start Germination (days) | Time to 50% Germination (T50) (days) | Mean emergence Time (MET) (days) | Final Germination % (FGP) | Germination Energy (GE) | Coefficient of uniform emergence (CUE) | Germination index (GI) | Skewness |
|---|---|---|---|---|---|---|---|---|
| Control‡ | 4a† | 5.20b | 6.74a | 83.33bc | 72.92ab | 0.80NS | 6.45bc | 0.77bc |
| PsJN Inoculation‡ | 3.33ab | 4.80c | 6.55a | 100a | 85.42a | 0.67 | 8.82a | 0.73c |
| Control§ | 4a | 5.60a | 6.83a | 77.08c | 64.58b | 0.85 | 5.45c | 0.82a |
| PsJN Inoculation§ | 3.33ab | 5.30ab | 6.73a | 89.58b | 68.75ab | 0.74 | 6.85b | 0.78ab |
| PsJN colonized seed‡ | 2.33bc | 4.33d | 5.49b | 100a | 69ab | 0.77 | 8.75a | 0.79ab |

†Values sharing similar letter(s) do not differ significantly at P < 0.05, according to Duncans Multiple Range Test.
‡Seeds prepared by spraying PsJN inoculum (10$^8$-10$^9$ CFU mL$^{-1}$)
‡Parent seed used for first year experiment
§ Offspring seed produced from first year experiment
1. a, b, c, d: The letters indicate significant differences. If the values are given the same letter they do not differ significantly. If they have different letters they are significantly different from each other.

TABLE 20

Comparative difference of PsJN inoculated and PsJN colonized seed on biomass of maize cv Peso in plastic tray experiment
(Data presented is the average of n = 3 independent replicates.)

| Treatment | Fresh Plant biomass (g) | | | | Dry Plant biomass (g) | | | | Plant height (cm) | No. of leaves per plant |
|---|---|---|---|---|---|---|---|---|---|---|
| | Stem | Leaves | Root | Total biomass | Stem | Leaves | Root | Total biomass | | |
| Control | 79.37 c† | 95.70 b | 37.20 b | 212.27 c | 3.63 c | 9.65 b | 1.39 b | 14.67 c | 93.37 b | 6.58 c |
| PsJN Inoculation | 93.77 b | 111.03 a | 38.4 ab | 244.43 b | 4.22 b | 10.65 ab | 1.73 a | 16.90 b | 95.87 a | 7.04 b |
| PsJN colonized seed‡ | 99.70 b | 113.33 a | 39.63 a | 251.43 ab | 4.39 b | 11.17 a | 1.79 a | 17.35 b | 97.33 a | 7.20 b |

†Values sharing similar letter(s) do not differ significantly at P < 0.05, according to Duncans Multiple Range Test.
‡Seeds prepared by spraying PsJN inoculum onto flowers (10$^8$-10$^9$ CFU mL$^{-1}$)

TABLE 21

Comparative performance of PsJN colonized seed and PsJN inoculation (exogenously) on plant biomass of maize cv Peso grown in pots
(Data presented is the average of n = 3 independent replicates.)

| | Pot trial I (Direct sowing) | | | | Pot trial II (Nursery sowing) | |
|---|---|---|---|---|---|---|
| Treatment | Plant height (cm) | No. of leaves per plant | Shoot biomass | Root biomass | Shoot biomass | Root biomass |
| Control | 96.42 c† | 6.98 c | 5.32 c | 0.82 c | 1.29 c | 0.28 c |
| PsJN Inoculation | 108.01 ab | 9.04 ab | 8.80 ab | 1.42 a | 2.37 b | 0.423 ab |

TABLE 21-continued

Comparative performance of PsJN colonized seed and PsJN inoculation
(exogenously) on plant biomass of maize cv Peso grown in pots
(Data presented is the average of n = 3 independent replicates.)

| | Pot trial I (Direct sowing) | | | | Pot trial II (Nursery sowing) | |
|---|---|---|---|---|---|---|
| Treatment | Plant height (cm) | No. of leaves per plant | Shoot biomass | Root biomass | Shoot biomass | Root biomass |
| PsJN colonized seed‡ | 104.62 b | 8.42 b | 7.17 b | 1.12 b | 2.16 b | 0.358 b |

†Values sharing similar letter(s) do not differ significantly at P < 0.05, according to Duncans Multiple Range Test.
‡Seeds prepared by spraying PsJN inoculum onto flowers ($10^8$-$10^9$ CFU $mL^{-1}$)

TABLE 22

Comparative performance of PsJN colonized seed and PsJN inoculated seed
(exogenously) on germination of maize cv Morignon
(Data presented is the average of n = 3 independent replicates.)

| Treatment | Time to Start Germination (days) | Time to 50% Germination (T50) (days) | Mean emergence Time (MET) (days) | Final Germination % (FGP) | Germination Energy (GE) | Coefficient of uniform emergence (CUE) | Germination index (GI) | Skewness |
|---|---|---|---|---|---|---|---|---|
| Control⸸ | 4.33a† | 4.98a | 6.72a | 85.42bc | 79.17ab | 0.81NS | 6.66b | 0.74NS |
| PsJN Inoculation⸸ | 3.67a-c | 4.96a | 6.65a | 95.83ab | 89.58a | 0.78 | 8.25a | 0.75 |
| Control§ | 4ab | 5.02a | 6.65a | 79.17c | 75b | 0.74 | 6.65b | 0.76 |
| PsJN Inoculation§ | 3.33bc | 5.07a | 6.59a | 91.67ab | 75b | 0.65 | 7.88ab | 0.77 |
| PsJN colonized seed‡ | 3c | 4.10b | 5.69b | 100a | 83.33ab | 0.69 | 9.06a | 0.72 |

†Values sharing similar letter(s) do not differ significantly at P < 0.05, according to Duncans Multiple Range Test.
‡Seeds prepared by spraying PsJN inoculum ($10^8$-$10^9$ CFU $mL^{-1}$)
⸸Parent seed used for first year experiment
§Offspring seed produced from first year experiment

TABLE 23

Comparative performance of PsJN colonized seed and PsJN inoculated seed
(exogenously) on seedling biomass of maize cv Morignon in plastic tray experiment
(Data presented is the average of n = 3 independent replicates.)

| | Fresh Plant biomass (g) | | | | Dry Plant biomass (g) | | | | | No. of |
|---|---|---|---|---|---|---|---|---|---|---|
| Treatment | Stem | Leaves | Root | Total biomass | Stem | Leaves | Root | Total biomass | Plant height (cm) | leaves perplant |
| Control | 81.07 c† | 97.70 b | 38.43 b | 215.93 c | 3.83 c | 9.67 c | 1.76 b | 15.26 c | 94.76N | 6.53 c |
| PsJN Inoculation | 92.67 b | 104.80 a | 42.40 a | 239.23 b | 4.64 b | 10.57 b | 2.34 a | 17.67 b | 95.00 | 6.87 b |
| PsJN colonized seed‡ | 92.90 b | 105.07 a | 41.93 a | 240.13 b | 4.66 b | 11.25 ab | 2.35 a | 18.24 ab | 95.02 | 6.84 b |

†Values sharing similar letter(s) do not differ significantly at P < 0.05, according to Duncans Multiple Range Test.
‡Seeds prepared by spraying PsJN inoculum ($10^8$-$10^9$ CFU $mL^{-1}$)

TABLE 24

Comparative performance of PsJN colonized seed vs PsJN inoculated seed (exogenously) on plant biomass of maize cv Morignon grown in pots (Data presented is the average of n = 3 independent replicates.)

| Treatment | Pot trial I (Direct sowing) | | | | Pot trial II (Nursery sowing) | |
|---|---|---|---|---|---|---|
| | Plant height (cm) | No. of leaves perplant | Shoot biomass | Root biomass | Shoot biomass | Root biomass |
| Control | 101.42 c† | 7.98 c | 6.36 c | 1.12 c | 3.29 c | 0.41 c |
| PsJN Inoculation | 110.67 b | 9.47 b | 8.17 b | 1.42 b | 4.37 b | 0.623 ab |
| PsJN colonized seed‡ | 113.01 ab | 9.83 b | 8.80 b | 1.56 ab | 4.26 b | 0.558 b |

†Values sharing similar letter(s) do not differ significantly at P < 0.05, according to Duncans Multiple Range Test.
‡Seeds prepared by spraying PsJN inoculum ($10^8$-$10^9$ CFU mL$^{-1}$)

Example 13

Introducing *B. phytofirmans* PsJN and *Enterobacter* sp. FD17 into Wheat and Barley Seeds Experiment Description Seeds of wheat (*Triticum* spp. cvs Collada and Monsun) and barley (*Hordeum vulgare* L. cvs Victoriana and Totum) were surface sterilized by dipping for 5 and 3 min in 70% ethanol and NaOCl, respectively, followed by 3 washings with sterilized water. Seeds were sown in plastic trays and 12 days old seedlings were transferred into 20 kg soil containers and grown under greenhouse conditions. The soil was collected from an agricultural field in Tulln, Lower Austria, and sieved to remove plant material. Bacterial strains (gusA-labelled variants of *B. phytofirmans* PsJN and *Enterobacter* sp. FD17) were grown by loop inoculation in LB broth amended with spectinomycin (100 µg mL$^{-1}$) in 100 mL Erlenmeyer flask. Bacterial cultures were incubated at 28° C. for 2 days at 180 rpm in a shaking incubator. Bacterial inoculum was applied by spraying exclusively flowers with one of the two bacterial strains. Control plants were treated with sterilized broth.

Endophytic Colonization of Wheat and Barley Seeds

Plants were harvested at ripening stage and seeds were collected. Seed colonization by the inoculant stains was determined by GUS-staining. Therefore, seeds were cut in two pieces and incubated in GUS-staining solution (1 mM EDTA, 5 mM potassium ferricyanide, 5 mM potassium ferrocyanide, 100 mM sodium phosphate, pH 7.0, 1% Triton-X-100, 0.1 mg/mL X-Gluc predissolved in 5 µL/mg N,N-dimethylformamide, 0.1% IPTG) directly after harvesting at 37° C. for 20 hours. Afterwards, samples were rinsed with 70% ethanol. The ethanol was then discarded and samples were fixed in paraformaldehyde solution (4% paraformaldehyde dissolved in PBS at 60° C. with constant stirring until clarifying of the solution) overnight at 4° C. Finally, the fixed samples were rinsed 3 times in PBS and stored in the last rinse at 4° C. until further processing. In parallel, seeds were manually crushed under sterile conditions and used for bacterial community DNA isolation employing standard procedures. The presence of the inoculant strains was confirmed by sequence analysis of the 16S-23S rRNA intergenic spacer region (IGS) of single clones and subsequent comparison with those from the inoculants strains.

Results Experiment A (1$^{st}$ Year):

Both seeds of wheat and barley were found to be internally colonized by the inoculants strains. Sequence analysis of the IGS-region confirmed the presence of *Enterobacter* sp. FD17 and *B. phytofirmans* PsJN.

Conclusions Example 13

*Burkholderia phytofirmans* PsJN and *Enterobacter* sp. FD17 can be introduced into barley and wheat seeds by spraying these microbes onto flowers.

Example 14

Introducing *B. phytofirmans* PsJN into Tomato and Pepper Seeds

Experiment A: Inoculation of Tomato and Pepper Flowers with *B. phytofirmans* PsJN::gusA110 and Detection by GUS Staining The colonization behavior of *Burkholderia phytofirmans* PsJN during transmission from flowers to seeds was studied in tomato (*Solanum lycopersicum* cv. Micro Tom and Matina) and pepper (*Capsicum annuum* cv. Feher). The presence of PsJN was investigated at 3 different timepoints. Detection of bacteria in the seed interior of harvested samples was conducted by GUS-staining and microscopy on the one hand and strain-specific quantitative PCR on the other hand. For detection by visual observation of staining and microscopy, the gusA-labelled variant of the strain PsJN, *Burkholderia phytofirmans* PsJN::gusA110, was used in parallel with the wild-strain that was detected via qPCR.

The ability of PsJN to survive in the seed and proliferate with the emerging seedling was studied in a subsequent germination experiment. The harvested seeds from the previously treated plants were sown and grown for a certain period. Afterwards the seedlings were examined regarding their presence of PsJN by GUS-staining and quantitative PCR of PsJN-specific genes.

The bacterial strains were grown by loop-inoculating one single colony in LB broth containing 0.1% of the antibiotic spectinomycin in case of *B. phytofirmans* PsJN::gusA110 and without antibiotics in case of the wild-type strain and incubated at 28° C. on a shaker (160 rpm) overnight. The overnight culture was transferred to 500 mL Erlenmeyer flasks containing 250 mL liquid LB medium. They were incubated on a shaker (120 rpm) at 28° C. for 2 days to allow for growth of bacteria. Subsequently, aliquots of 40 mL of the incubated medium containing the bacterial culture were added to 50 mL plastic tubes and centrifuged at 4500 rpm and 4° C. for 10 minutes (Megafuge 40R, Heraeus, Hanau, Germany). Afterwards, the supernatant was discarded and the bacterial pellet re-suspended in 20 mL PBS (0.2 g/L KCl, 1.44 g/L Na2HPO4 and 0.24 g/L KH2PO4, in dH2O, pH 7.4, autoclaved). The control suspension was treated accordingly. The aliquots of each bacterial suspension were then pooled in 500 mL Schott bottles. The concentration of the suspensions was measured by spectrophotometry (NanoDrop 1000 3.7.1., Wilmington, Del., USA) and adjusted to $3 \times 10^8$ CFU/mL.

Specific inoculation of tomato and pepper flowers was conducted when the plants reached growth stage 61-63 on the BBCH scale (for tomato: first inflorescence: first flower open—third inflorescence: first flower open; for pepper: first flower open—third flower open) (Feller et al., 2001).

Figure 6:
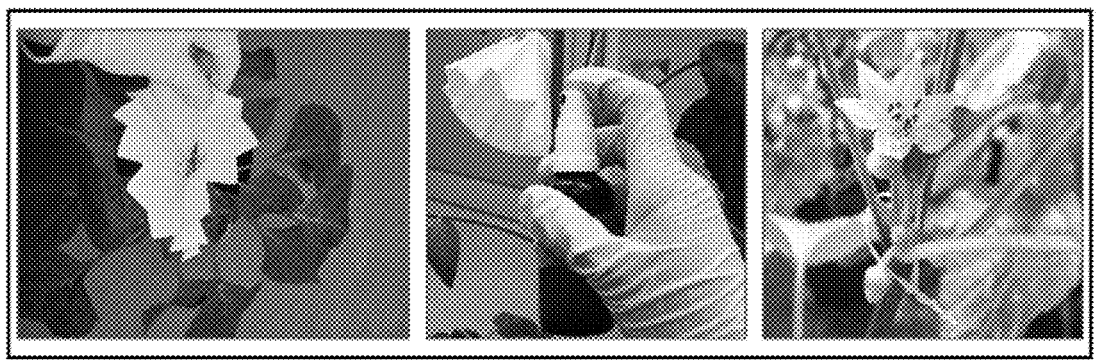
FIG. 6 shows the spraying of pepper flowers to introduce a novel microbe. Pepper flowers were shielded with a filter paper, sprayed with 675 µL bacterial suspension in a concentration of $3 \times 10^8$ CFU/mL and marked.
Figure 7:
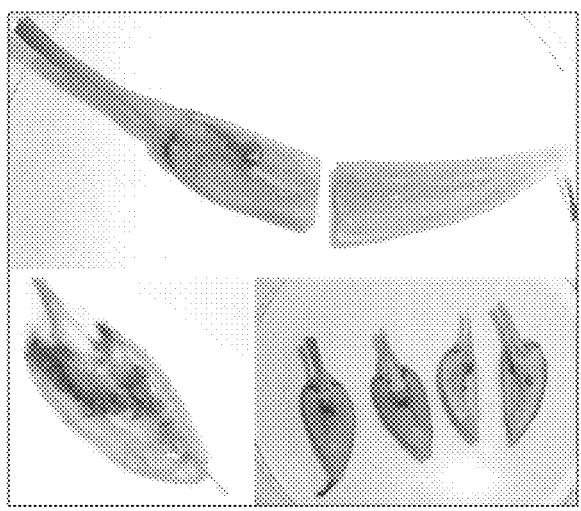
FIG. 7 shows representative results of GUS-staining in pepper treated with hormone-producing, phosphate-solubilizing PsJN that was genetically engineered with gusA110 15 days post inoculation (dpi) GUS-activity, demonstrated by blue dye accumulation, was found in all plant parts including seeds indicating the presence of PsJN inoculant (top shows GUS-activity in pericarp, peduncle, seed and placenta, bottom right shows GUS-activity in seeds, bottom left is negative). Not all samples tested positive (replicate number n=6).
Figure 8:
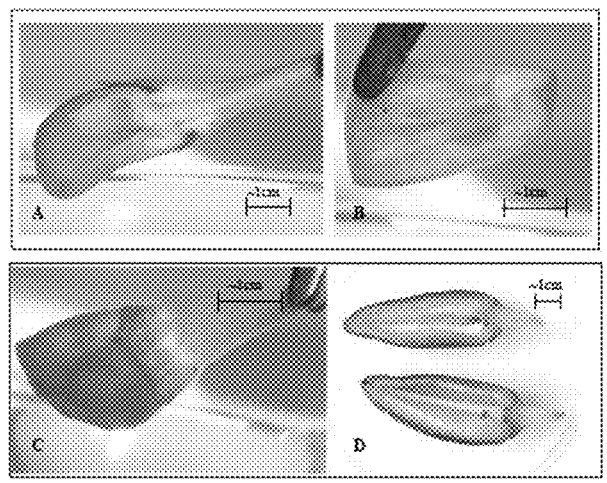
FIG. 8 Shows representative result of GUS-staining of control pepper 15 dpi. Low GUS-activity was found in peduncle (image C) and pericarp (image B and D) (replicate n=6). Generally, staining occurred less frequently than in the PsJN::gusA 110 treated plants.
Figure 9:
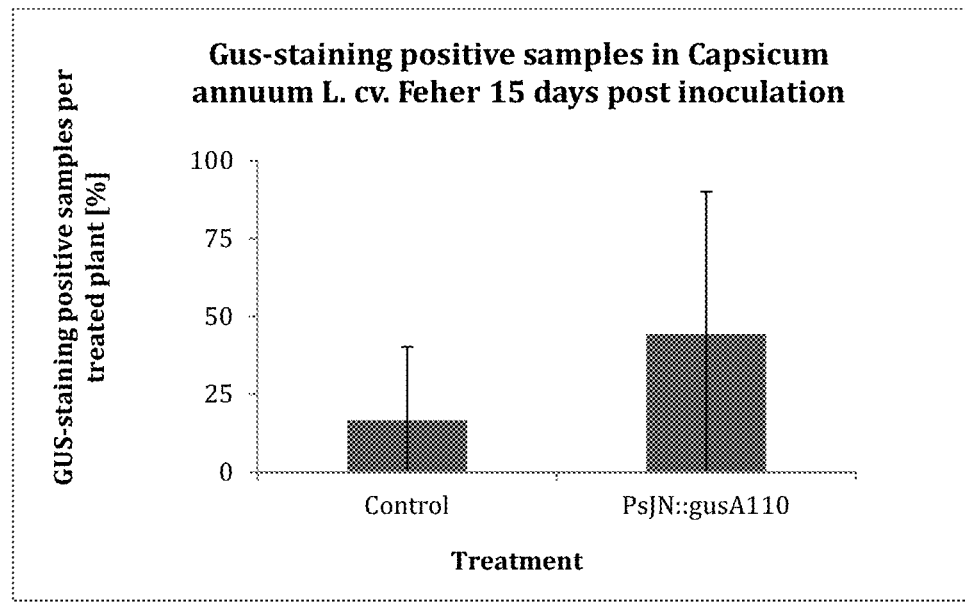
FIG. 9 shows GUS-staining positive samples in pepper 15 days post inoculation (dpi). The percentage of treated flowers/fruits per plant, which were GUS-positive in an examination 15 dpi, was 17% in the control and 46% in the PsJN::gusA 110 treatment (replicate n=6).
Figure 10:
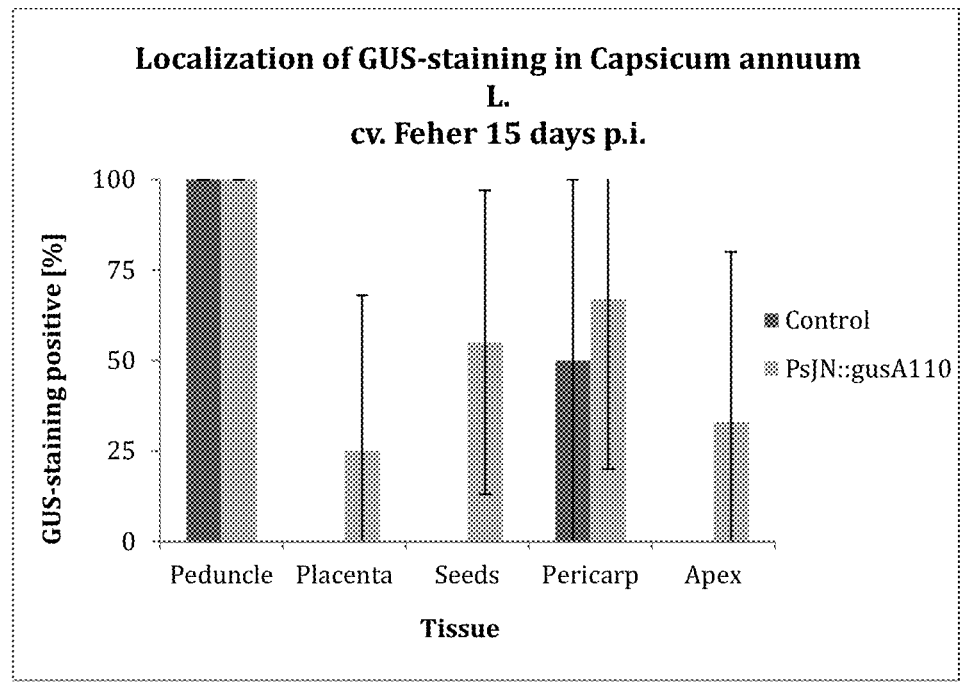
FIG. 10 shows the localization of GUS-staining in pepper 15 dpi. GUS-responsiveness in different anatomic parts examined in GUS-positive samples shows that only after PsJN::gusA 110 treatment, staining can be found in placenta, seeds and apex. Staining in the control was only found in peduncle and partly in the pericarp. Differences in intensity were negligible and are not displayed.
Figure 11:
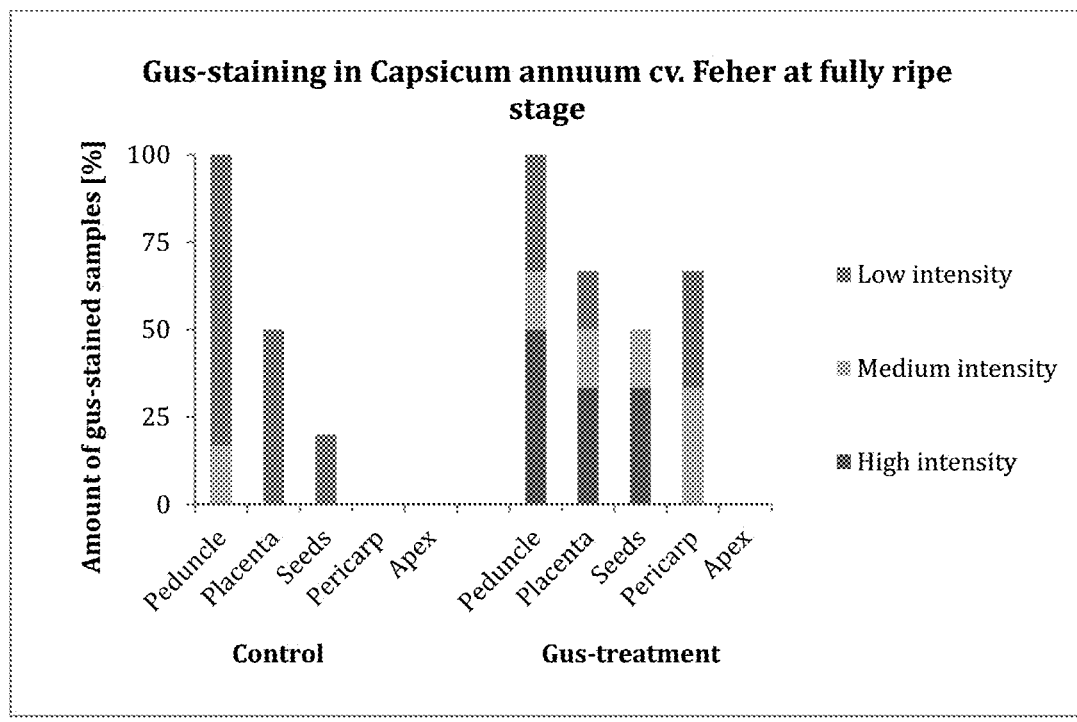
FIG. 11 shows the localization of GUS-staining in fully ripe pepper. GUS-staining was more intense and frequent in PsJN::gusA 110 treated samples. Only in these, high amounts of GUS-activity are detected in peduncle, placenta and seeds.
Figure 12:
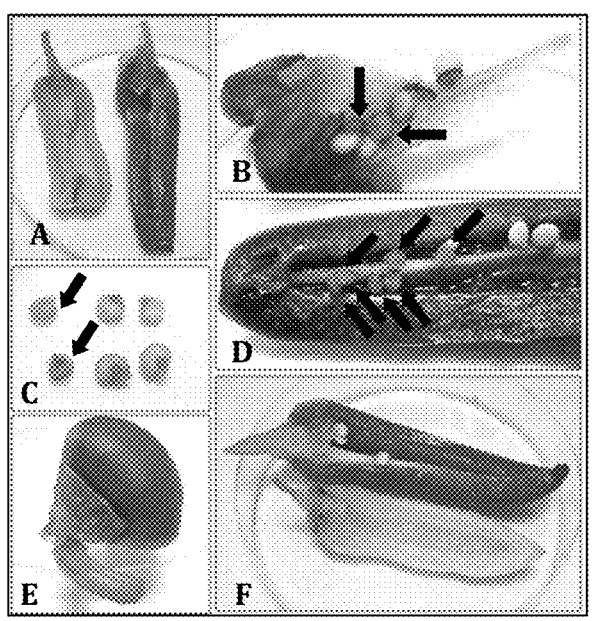
FIG. 12 shows a representative result of GUS-staining in pepper treated with PsJN::gusA110 harvested ripe. GUS-staining reached a very high intensity in 40-50% of samples and was preferably localized in peduncle (images A, B, E, F). GUS-activity was observed in about 50% of cases inside seeds as indicated by black arrows (images B, C, D). GUS-activity was also found in pericarp (images A, D, E) and placenta (images A, B, F).
Figure 13:
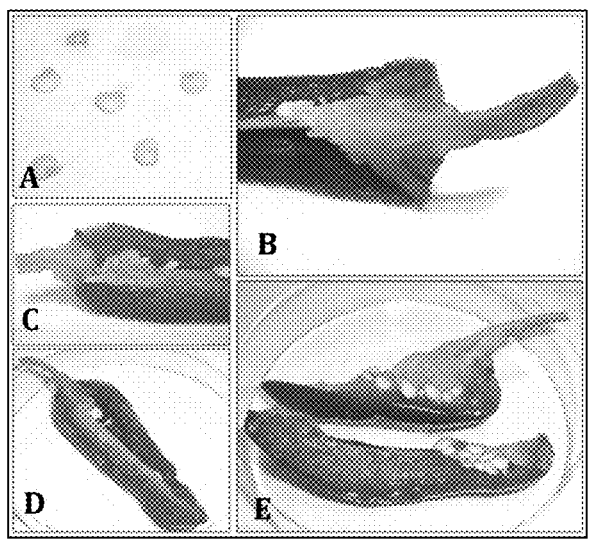
FIG. 13 shows the representative results of GUS-staining in control pepper harvested at ripe stage. GUS-staining intensity was generally weak and in most cases restricted to the peduncle (images B, C, D, E). In 50% of GUS-active samples, staining was observed in placenta (image D). Fruit sizes vary between 8-12 cm (scale bar not shown).
Figure 14:
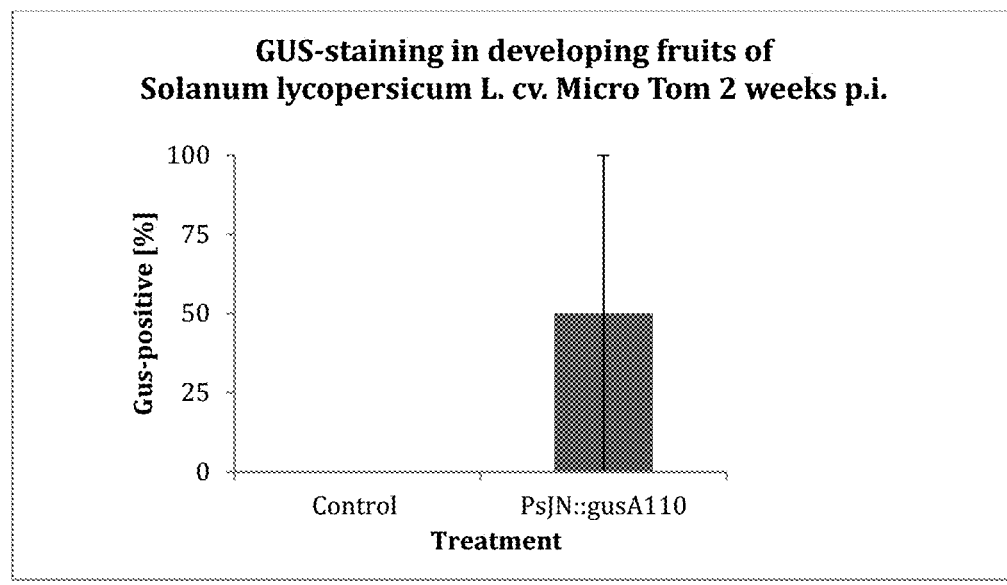
FIG. 14 shows the results of GUS-staining tomato cv. Micro Tom 2 weeks post inoculation. In 50% of sprayed inflorescences (replicates n=6), GUS-activity was observed in at least one developing fruit. No GUS-activity was observed in the control.
Figure 15:
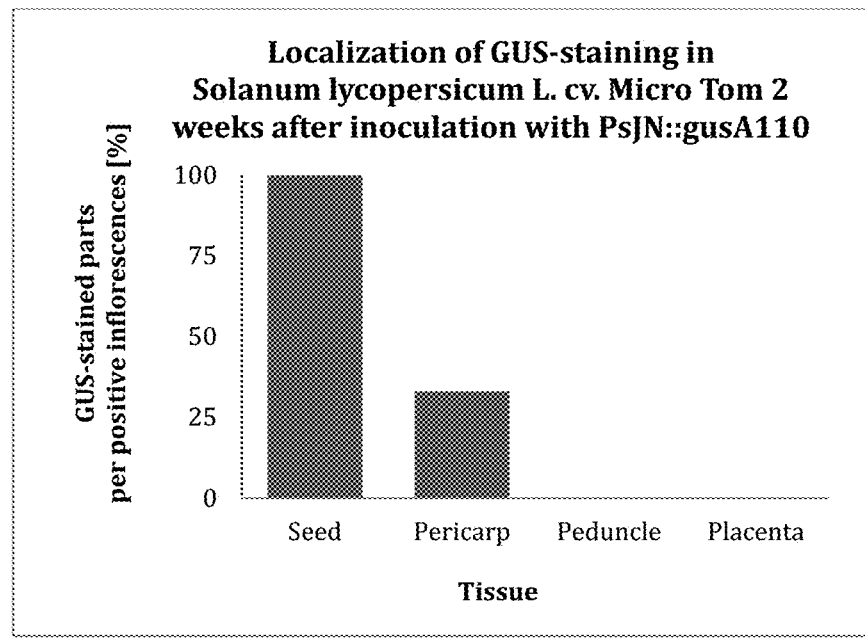
FIG. 15 shows the localization of GUS-staining in tomato cv. Micro Tom 2 weeks post inoculation. Among the positive samples of PsJN::gusA110 inoculated plants, GUS-staining was located to 100% in seeds and to 25% of in the pericarp.
Figure 16:
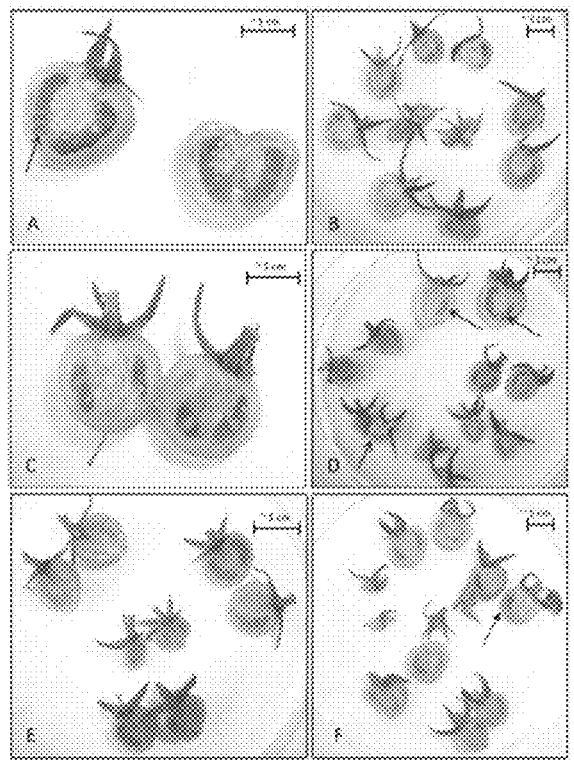
FIG. 16 shows the GUS-staining in tomato cv. Micro Tom treated with PsJN: gusA110 2 weeks post inoculation. All fruits yielded from 6 replicate inflorescences developing into different amounts of fruits are shown. Replicates A, D and F contain GUS-positive fruits.
Figure 17:
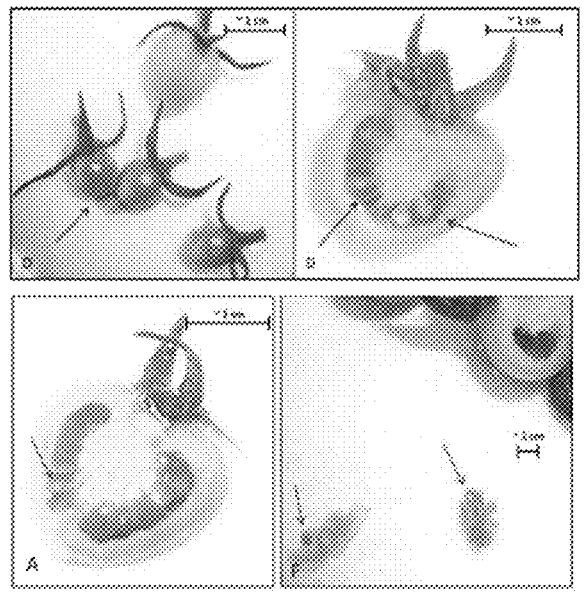
FIG. 17 shows the enlarged GUS-positive samples of tomato cv. Micro Tom 2 weeks post inoculation. Replicate D, A and F display GUS-activity in seeds. Replicate D additionally shows GUS-activity in the pericarp of two small fruits.
Figure 18:
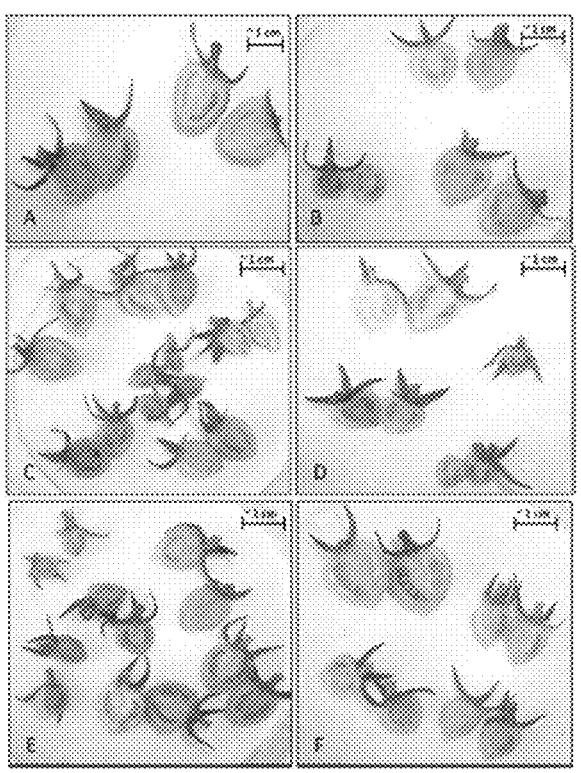
FIG. 18 shows the GUS-staining in control tomato cv. Micro Tom 2 weeks post inoculation. All 6 replicates are shown. No GUS-activity could be observed in control plants as shown by images A-F.
Figure 19:
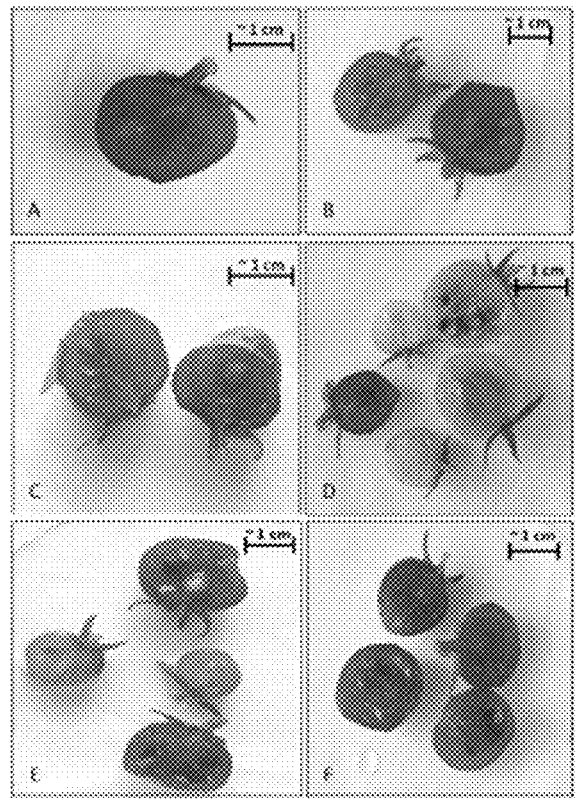
FIG. 19 shows GUS-staining in tomato cv. Micro Tom treated with PsJN::gusA110 harvested ripe. All 6 replicates are shown and consist of different amounts of fruits. GUS-staining is concentrated in seeds and placenta (Images B, D, E, F). No GUS-activity is observed in pericarp and peduncle (Images A-F).
Figure 20:
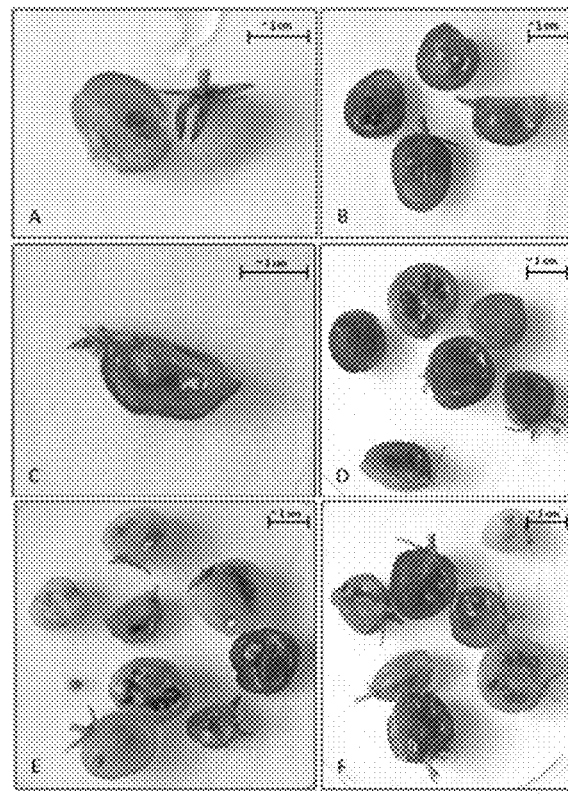
FIG. 20 shows GUS-staining in control tomato cv. Micro Tom harvested at fully ripe stage. All 6 replicates are shown and consist of different amounts of fruits. Staining is mostly found in seeds, placenta and pericarp (images B, D, E, F).
Figure 21:
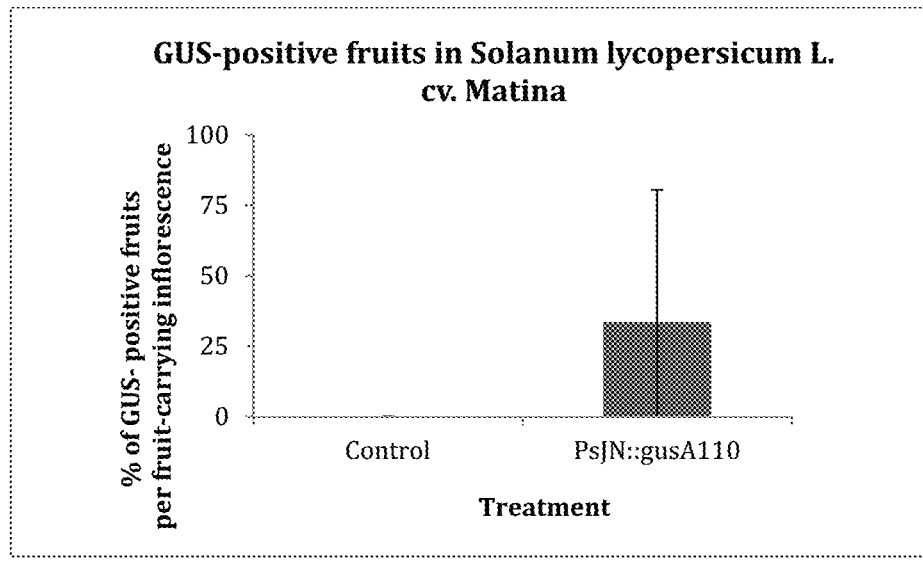
FIG. 21 shows GUS-staining in tomato cv. Matina 1 week post inoculation. Developing fruits with GUS-activity were only found in inflorescences inoculated with PsJN::gusA110. Where inflorescences had developed small fruits, 33% of them stained blue.

The bacterial inoculants and the buffer only for control were added to a 50 mL glass pump spray bottle previously sterilized with 70% ethanol. The plants to be inoculated were spatially separated from the others to avoid contamination by drift. One single flower or 2 to 3 immediately adjacent flowers were sprayed with 675 µL of the inoculum. A filter paper was used to shield the surrounding plant parts such as leaves and stem from drift and take up surplus inoculum to avoid dripping on the soil. The treated inflorescences/flowers were marked with a twist tie to enable later identification (FIG. 6).

Six replicates of the inoculated plants were analyzed at 3 different developmental stages. Pepper samples were taken 3 days and 15 days after spraying as well as at full ripeness. The plant material (buds, flowers, fertilized flowers, developing fruits, immature fruits, ripe fruits and seeds) was cut with a sterile scalpel and subsequently incubated in GUS-staining solution (1 mM EDTA, 5 mM potassium ferricyanide, 5 mM potassium ferrocyanide, 100 mM sodium phosphate, pH 7.0, 1% Triton-X-100, 0.1 mg/mL X-Gluc predissolved in 5 µL/mg N,N-dimethylformamide, 0.1% IPTG) directly after harvesting at 37° C. for 20 hours. Afterwards, destaining was done by rinsing the samples with 70% ethanol. The ethanol was then discarded and the samples fixed in paraformaldehyde solution (4% paraformaldehyde dissolved in PBS at 60° C. with constant stirring until clarifying of the solution) overnight at 4° C. Finally, the fixed samples were rinsed 3 times in PBS and stored in the last rinse at 4° C. until further processing.

Material of plants inoculated with PsJN wild-type and control samples were immediately after harvest frozen in liquid nitrogen and transferred for storage at −80° C. Afterwards, DNA was isolated using standard procedures and used as described above for Example 13.

Results Experiment A (1$^{st}$ Year):

Upon flower spraying *B. phytofirmans* PsJN colonized seeds and pericarp of fruits of tomato and pepper. The colonization process was monitored by GUS-staining and microscopy (FIGS. 7-21). In summary, GUS-staining was found preferentially in the fruit and seeds of tomatoes and peppers that developed from flowers treated with PsJN::gusA110, but in most cases not in the ones derived from control treatments.

Experiment B: Detection of PsJN in Plant Tissues (Fruits and Seeds) using qPCR

DNA was extracted from pepper plant material, which had been obtained at various time-points after inoculation with PsJN wild type and control inoculants or stored at −80° C. Pepper plant material was spooled in mortars separated by treatments and finely ground while constantly replenishing liquid nitrogen in order to avoid thawing. Approximately 100 mg of the pulverized samples were transferred to three 2 mL plastic tubes (free of detectable DNase, RNase and human DNA, by Greiner Bio One, Frickenhausen, Germany) and stored on liquid nitrogen until further treatment. The same was done with 6 replicate seedlings having emerged from seeds obtained from the parental generation inoculated with PsJN wild type and control. 15 seeds from the pooled replicates, which had been stored for 2 months were put in a 2 mL Eppendorf tube containing a metal ball and homogenized by help of a ball mill (Ball Mill MM31 by Retsch, Haan, Germany) at 30 Hz for 90 seconds. DNA was extracted using the CTAB method essentially as described by Stralis-Pavese, Nancy, et al., *Nature protocols* 6.5 (2011): 609-624. The quality and concentration of the extracted DNA was measured with a ThermoScientific NanoDrop and gel electrophoresis. Where applicable, RNA was removed by incubating the DNA suspension with 2 µL RNAse on a thermomixer at 37° C. for 1-1.5 hours.

For absolute quantification of PsJN DNA in pepper samples, a TaqMan-PCR assay was performed. A primer set (2615) specific for *Burkholderia phytofirmans* PsJN had been constructed in a previous study. The gene encoding for glutamine synthetase was the basic target for this primer set, which will allow for amplification of a fragment consisting of 84 nucleotides. The sequence of the forward primer was ATCCGTGGCCGACGTCGTGC (5'→3') (SEQ ID 1218), the sequence of the reverse primer was GCAACACGTTTCGGTGCCGGTGT (5'→3') (SEQ ID 1219). Additionally, a specific probe labeled with FAM-5' and 3'-BHQ had been developed previously, which bound to the inner part of the amplicon at a distance of 59 nucleotides from the forward primer. The sequence of this probe was TTGTCGACTTTCGTTTCACC (5'→3') (SEQ ID 1220). For a final volume of 20 µL (including 1 µL template) for each reaction tube, a master mix was prepared as follows:

10 µL SsoFast Probes Supermix (2× solution, by Bio-Rad)
1 µL forward primer [100 µM]
1 µL reverse primer [100 µM]
1 µL probe [50 µM]
6 µL Milli-Q H2O 19 µL of the previously prepared master mix were pipetted into the wells of a 96-well PCR plate and 1 µL of the respective sample was added. The well plate was then tightly sealed with self-adhesive film and the reaction mix spun down in a centrifuge at 4° C. for 20 seconds (2000 rpm). The qPCR was run on a Bio-Rad real-time detection system CFX96 (Bio-Rad, Hercules, Calif., USA) at the following settings: Hot start at 95° C. for 2 minutes, 69 cycle denaturation at 95° C. for 5 seconds and hybridization and elongation for 20 seconds.

Figure 22:
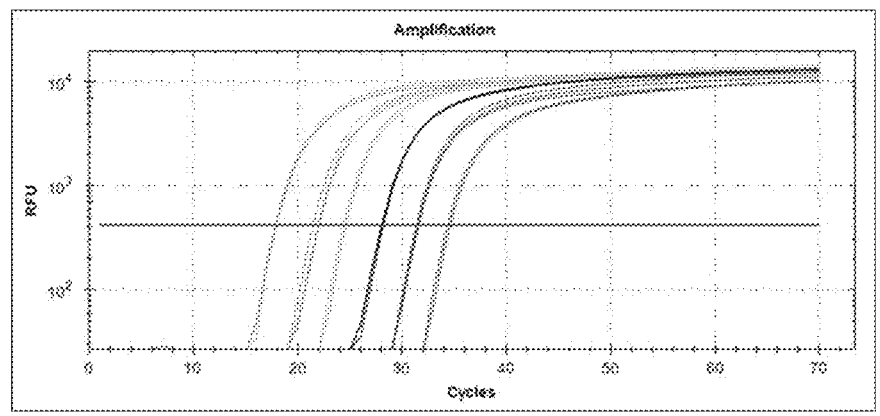
FIG. 22 shows the qPCR amplification curves of standards. The regular spaces between standard dilutions and the indistinguishability of the technical replicates reflect ideal qPCR reactions.
Figure 23:
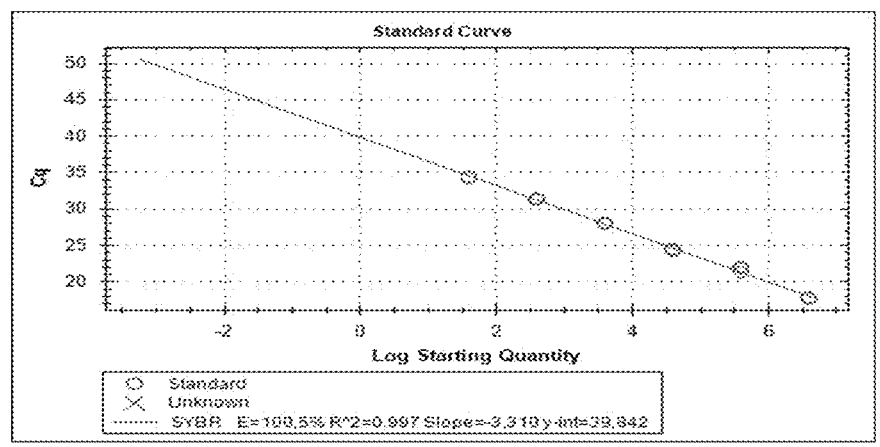
FIG. 23 shows the standard curve constructed from dilution series. The efficiency E of 100.5% and $r^2$ of 0.997 as well as a slope of −3-310 reflect ideal qPCR run.

Additionally, for absolute quantification of DNA in the pepper samples, a calibration curve was generated from the real-time qPCR results of 3 respective replicates of a 10-fold serial dilution of purified DNA (344.2 ng/µL) extracted from *B. phytofirmans* PsJN (FIGS. 22 and 23). Unknown starting quantity of DNA copy numbers in the samples could be calculated based on the standard curve from the dilution series of known concentrations, which produced an $r^2$ value of 0.997. All data analysis was performed by help of the software Bio-Rad CFX Manager 3.0.

Results Experiment B

Figure 24:
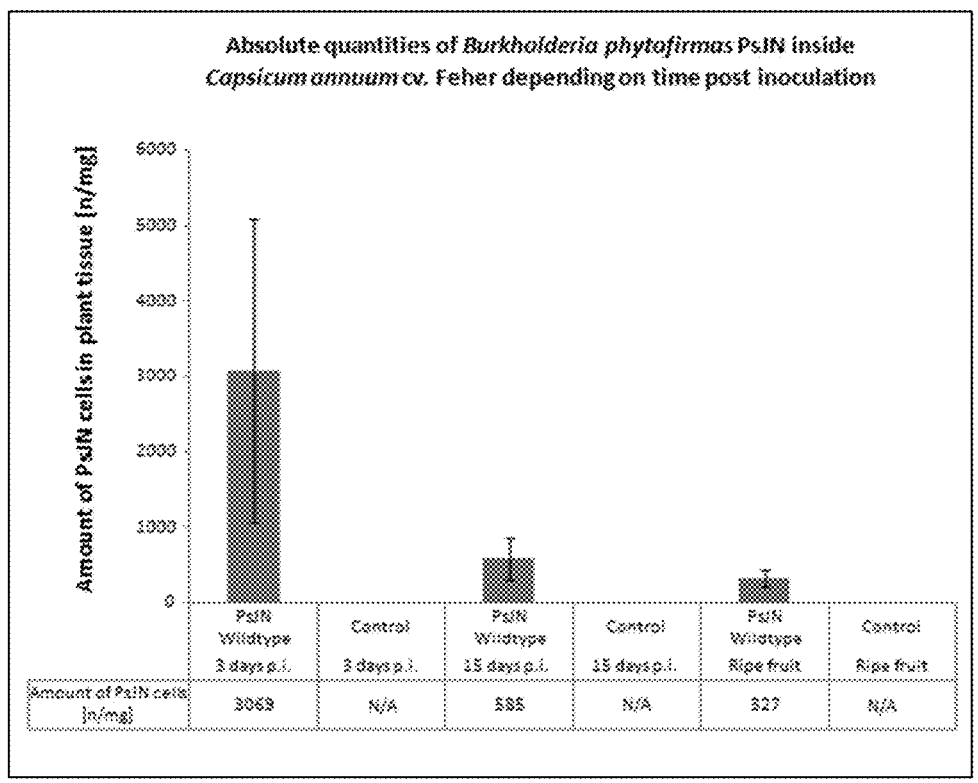
FIG. 24 shows the amount of hormone-producing, phosphate-solubilizing PsJN detected in pepper samples through qPCR. PsJN is found in samples sprayed with the bacterial inoculum at developmental stages examined. The concentration of PsJN cells in plant tissue decreases with advancing fruit growth. No PsJN is found in control plants.

The results of qPCR analysis show that 3 days after the treatment (FIG. 24), the amount of detected DNA was rather high and corresponded to 3069 cells/mg, whereas this value had steeply declined 12 days later (at 15 days p.i.) when 585 cells/mg were detected. At the final point of examination, the fully ripe stage, the amount of cells found was even less (327 cells/mg) but the decrease had not continued proportionally to the first 15 days. Although the larger amounts of PsJN detected in the first 15 days might have been due to dead bacteria left-over from the initial spray, in the ripe fruit, the absolute amount of bacterial DNA may be assigned exclusively to bacteria inside the plant tissue. It showed the lowest value of all time-points, which may be due to the dilution effect from increasing fruit size.

Gel analysis showed a clear band at the expected fragment size of 84 bp in samples treated with the PsJN wild type inoculum in all stages examined. The fragment was absent in control samples, PsJN inoculated seed samples and in the negative control. The intensity of the band was consistent with the quantification of PsJN in the sample by qPCR: Samples harvested 3 days p.i. showed the highest intensity, which declined with an increasing time interval after inoculation. However, the signal appearing in qPCR may not have derived from the amplified 84 bp fragment alone. A second band of lower fragment size appears on the gel in all samples including the negative control (therefore likely primer-dimers).

Figure 25:
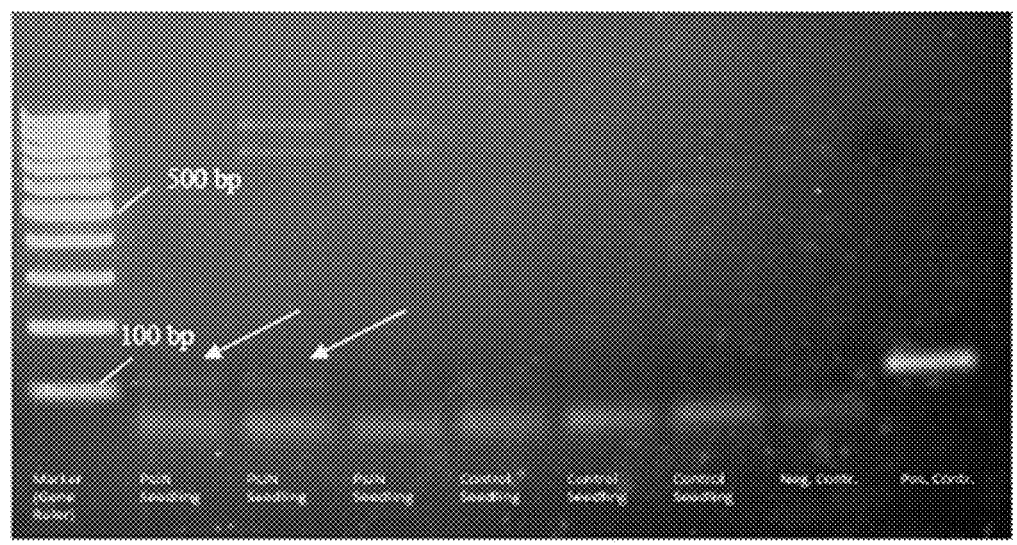
FIG. 25 shows the results of PCR of pepper samples with primer pair 2615 and gel analysis. A faint band is observed, with the same molecular size as the one in the positive control, in two replicates of DNA extracted from seedlings obtained from P inoculated with hormone-producing, phosphate-solubilizing PsJN wild type.

Concerning analysis of seed samples, which had been separated from the ripe fruits, PsJN could not be detected by qPCR due to the extreme sensitivity of this method to disturbance by impurities. It was presumably the large amount of starch stored in the seed, which impeded the PCR reaction. Purification of the extracted DNA came at the expense of DNA quantity which could not sufficiently be counteracted by re-precipitation and concentration. Therefore, DNA extracted from seedlings was amplified instead. In this case, an extremely low signal could be obtained for two of the three replicates by PCR and gel analysis (FIG. 25). However, no signal was obtained by qPCR.

Experiment C: Detection of PsJN in Pepper Plant Tissues (Seeds) using FISH

Following the recommendations of Moter and Gobel (2000), Journal of Microbiological Methods 41: 85-112, probes were designed targeting the 16S rRNA and 23S rRNA of *Burkholderia phytofirmans* strain PsJN (B. phyt23S 5'-CTC TCC TAC CAT GCA CAT AAA-3; SEQ ID 1221) and labeled with the fluorophore Cy5 at the 5'-end. FISH of pepper sections was conducted with the following reaction settings: 10% formamide, 46° C. hybridization temperature, 48° C. post-hybridization temperature. Domain-level probes (EUB338I 5'-GCT GCC TCC CGT AGG AGT-3', SEQ ID 1222; EUB338II 5'-GCA GCC ACC CGT AGG TGT-3', SEQ ID 1223; and EUB338III 5'-GCT GCC ACC CGT AGG TGT-3', SEQ ID 1224; Amann and Fuchs, 2008) labeled with FITC makes microbes appear green, while simultaneous binding of B. phyt 23S and EUB338 probes will make them appear yellow and thereby identify PsJN. Subsequent to FISH, the samples were observed under a confocal microscope (Olympus Fluoview FV1000 with multi-line laser FV5-LAMAR-2 HeNe(G) laser FV10-LAHEG230-2) applying a 20 x objective. Pictures were taken at 405 nm, 488 nm and 549 nm wavelength and merged (RGB) by the software ImageJ.

Results Experiment C

Figure 26:
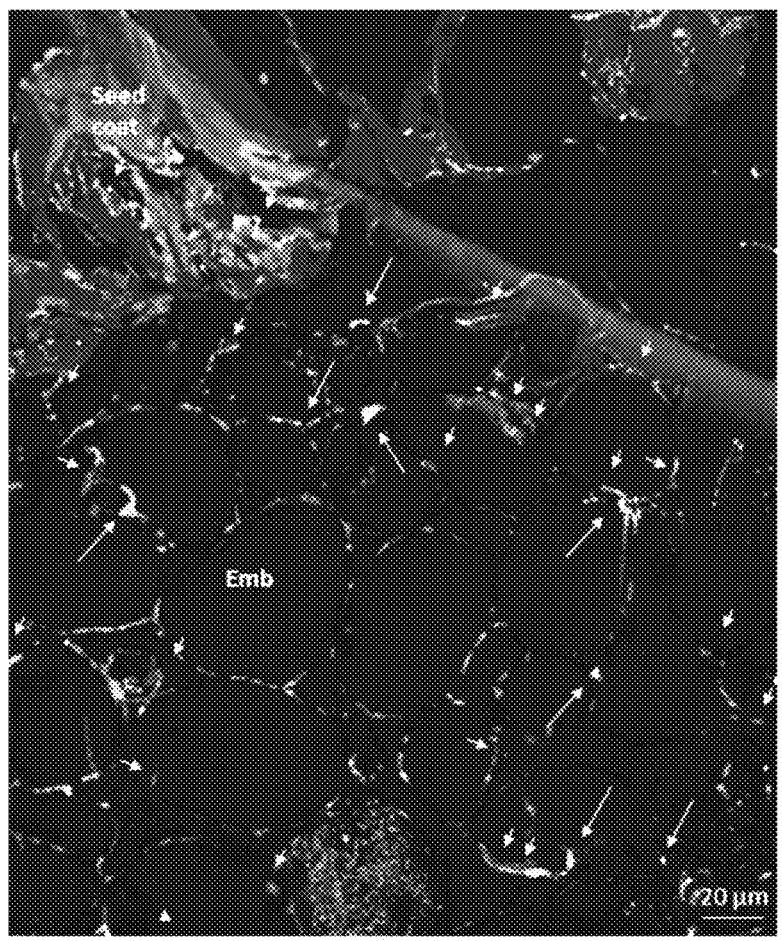
FIG. 26 shows the results of Fluorescent In Situ Hybridization (FISH) analysis of pepper seeds colonized by PsJN::gusA110 using EUB338 probe mix and probe 23S B. phyt. The general EUB338 probe mix is labeled with FITC and makes all bacteria present in the sample appear green. The PsJN specific probe 23S B. phyt is labeled with Cy5 (red fluorescence), therefore hormone-producing, phosphate-solubilizing PsJN appears yellow due to the double labeling by FITC+Cy5. Large arrows indicate PsJN, while small arrows indicate other microbes. PsJN is found in cells of the embryo (Emb), but not in the seed coat.

Yellow fluorescent bacteria PsJN were found inside the embryo along with a very large amount of other unknown bacteria (green fluorescent), which also colonized the seed coat (FIG. 26).

Experiment D: Detection of PsJN in Pepper and Tomato F1 Seedlings Using X-Glue Staining During the sample harvesting of the fully ripe fruits, seed material for a subsequent germination experiment was gathered. In the case of tomato, seeds were collected in a fine sieve and rinsed with tap water while gently rubbing off the mucilaginous seed coat containing germination inhibiting substances. Seeds were stored for drying at room temperature (in the dark) in Petri dishes containing a filter paper to remove residual moisture. 3-4 weeks later, the seed material was transferred to 4° C. for cool treatment to break seed dormancy for germination.

The germination assay was carried out with seeds of tomato cv. Micro Tom 3 weeks after harvesting and a 24 hour period at 4° C. and with seeds of pepper 7 weeks after harvesting and a 3 week period at 4° C. In both cases, seeds were surface sterilized prior to spreading them on the growth substrate. For this, seeds of all 6 replicates of the different treatments (PsJN wild type, PsJN::gusA110, control) were pooled put in a sieve and soaked in 70% ethanol for 1 minute followed by a bath in 3.5% NaClO for 15 minutes. Afterwards, they were rinsed 6 times with dH2O. Subsequently, 25 seeds were distributed evenly on 140 mm Petri dishes containing water agar (1%, previously autoclaved). 2-3 mL dH2O were added to ensure proper imbibition of seeds. The Petri dishes were incubated at 27° C. in the dark. Seedlings were incubated in GUS-staining solution (1 mM EDTA, 5 mM potassium ferricyanide, 5 mM potassium ferrocyanide, 100 mM sodium phosphate, pH 7.0, 1% Triton-X-100, 0.1 mg/mL X-Gluc predissolved in 5 µL/mg N,N-dimethylformamide, 0.1% IPTG) directly after harvesting at 37° C. for 20 hours. Samples were then destained by rinsing the samples with 70% ethanol, discarded, and the samples fixed in paraformaldehyde solution (4% paraformaldehyde dissolved in PBS at 60° C. with constant stirring until clarifying of the solution) overnight at 4° C. Finally, the fixed samples were rinsed 3 times in PBS and stored in the last rinse at 4° C. until further processing.

Results Experiment D

Figure 27:
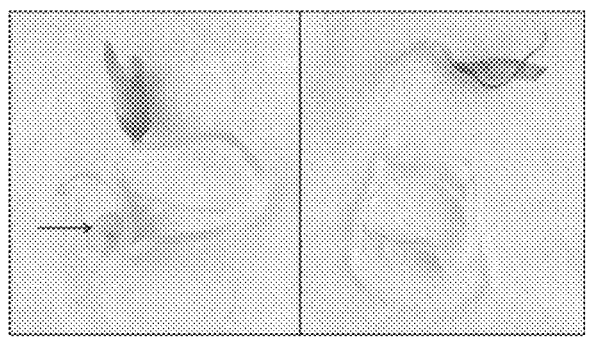
FIG. 27 shows GUS-staining in pepper seedlings (P treated with PsJN::gusA110) 4 weeks after germination. GUS-activity is below detection limit with the naked eye except in the empty seed coat. However, few stained cells (n=10-25 per seedling) were observed by microscopy in stems of seedlings. Images show a representative selection of replicates (n=6).

GUS-activity in pepper seedlings obtained from this germination experiment was below detection limit by optical examination without additional equipment. When observed under a confocal microscope (FluoView FV1000 by Olympus, Tokio, Japan) at brightfield settings, few blue cells were observed and ranged from 10-25 per seedling, mostly located in the stem. Where an empty seed coat was still attached to the seedling and was also subjected to GUS-staining, the coat was found to stain slightly blue. This observation concerned the control seedlings as well as the ones obtained from parent plants inoculated with PsJN::gusA110. However, a meaningful quantification of GUS-activity occurring in the seed coat is not possible due to the fact that it was only in few cases still attached to the seedling. It is not unlikely though, that other endophytic bacteria not yet characterized may be present in our pepper plants and lead to the appearance of a blue background in control samples (FIG. 27).

Figure 28:
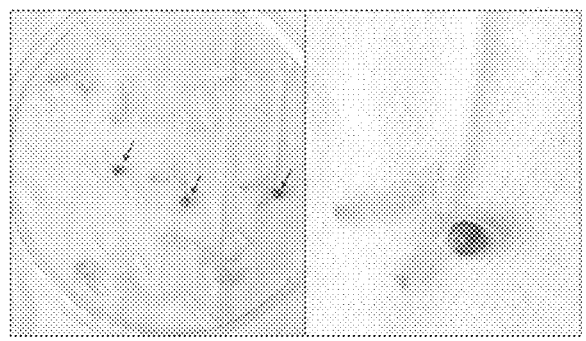
FIG. 28 shows GUS-staining in tomato cv. Micro Tom seedlings (P treated with PsJN::gusA110) 5 weeks after germination. One seedling shows GUS-activity in the tips of the cotyledons. Empty seed coats display GUS-activity.

As in the case of pepper, GUS-staining of tomato seedlings was hard to detect with the naked eye except in empty seed coats of both control and PsJN::gusA110 treatment. However, in one seedling of the treated parental generation, a transition of the GUS-activity from the seed shell to the tips of the cotyledons could be observed (FIG. 28).

Experiment E: Germination of F1 Pepper and Tomato Seeds Colonized with PsJN

During the sample harvesting of the fully ripe fruits, seed material for a subsequent germination experiment was gathered. In the case of tomato, seeds were collected in a fine sieve and rinsed with tap water while gently rubbing off the mucilaginous seed coat containing germination inhibiting substances. Seeds were stored for drying at room temperature (in the dark) in Petri dishes containing a filter paper to remove residual moisture. 3-4 weeks later, the seed material was transferred to 4° C. for cool treatment to break seed dormancy for germination.

The germination assay was carried out with seeds of tomato cv. Micro Tom 3 weeks after harvesting and a 24 hour period at 4° C. and with seeds of pepper 7 weeks after harvesting and a 3 week period at 4° C. In both cases, seeds were surface sterilized prior to spreading them on the growth substrate.

For this, seeds of all 6 replicates of the different treatments (PsJN wild type, PsJN::gusA110, control) were pooled put in a sieve and soaked in 70% ethanol for 1 minute followed by a bath in 3.5% NaClO for 15 minutes. Afterwards, they were rinsed 6 times with dH2O.

Subsequently, 25 pepper and tomato seeds were distributed evenly on 140 mm Petri dishes containing water agar (1%, previously autoclaved). 2-3 mL dH2O were added to ensure proper imbibition of seeds. The Petri dishes were incubated at 27° C. in the dark. Additionally, 25 surface-sterilized seeds of pepper were spread on seed trays containing potting soil (Compo Sana Anzucht- and Krauter- erde), slightly covered with potting soil, irrigated, covered with a plastic sheet and left for germination at 26° C. day temperature/22° C. night temperature in the greenhouse. This growth environment was not tested with seeds of tomato cv. Micro Tom due to a lack of seed material available. In the growth chamber as well as in the greenhouse, the germination process was constantly monitored and documented until no further germination could be observed for 3 subsequent days.

Results for Experiment E

Pepper seeds showed a similar behavior on both water agar and potting soil as a growth medium. On water agar, initial germination was observed on the 7th day after sowing and on potting soil on the 8th day. Germination of all batches was completed after 23 days on water agar, while it took only 20 days to reach the maximum germination rate in all batches on potting soil. The control seeds and the PsJN:: gusA110 inoculated seeds started to germinate on both media roughly equally in time and showed overall a parallel development. PsJN::gusA110 inoculated seeds performed somewhat better under either growth conditions than the control, which was exemplified by their earlier germination when sown on water agar in comparison to the control. However the two treatments were found to meet again on the maximum level of 92% germination. On potting soil, the better performance became manifest in the constantly steep germination rate of the PsJN::gusA110 inoculated seeds until reaching the maximum, whereas the control appeared to suffer from a slight lag phase prior to reaching the same maximal value (84% of seeds germinated) as the PsJN:: gusA110 inoculated seeds. The seeds obtained from parent plants inoculated with the PsJN wild type strain however showed a significant delay in their germination behavior on both growing media. While these observations strongly demonstrate that the inoculation of flowers lead to incorporation of PsJN wild type into the seed, the actual effect on the seeds is obviously not the desired one. However, despite the fact that the growth-promoting effect of *Burkholderia phytofirmans* PsJN on plants in later developmental stages has been proven in many cases, there are currently no studies available examining the effect on seeds.

Figure 29:
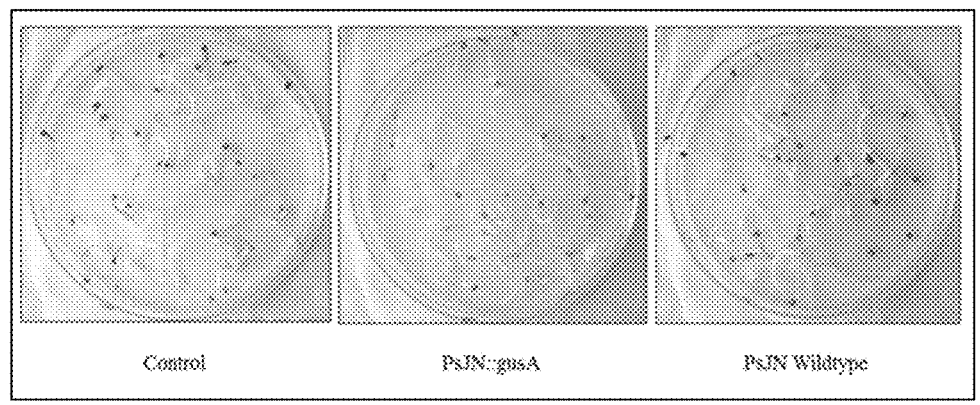
FIG. 29 shows the germination of F1 tomato cv. Micro Tom on agar plates, 7 days after sowing. No difference in germination behavior could be observed between treatments (total amount of seeds per plate=25).
Figure 30:
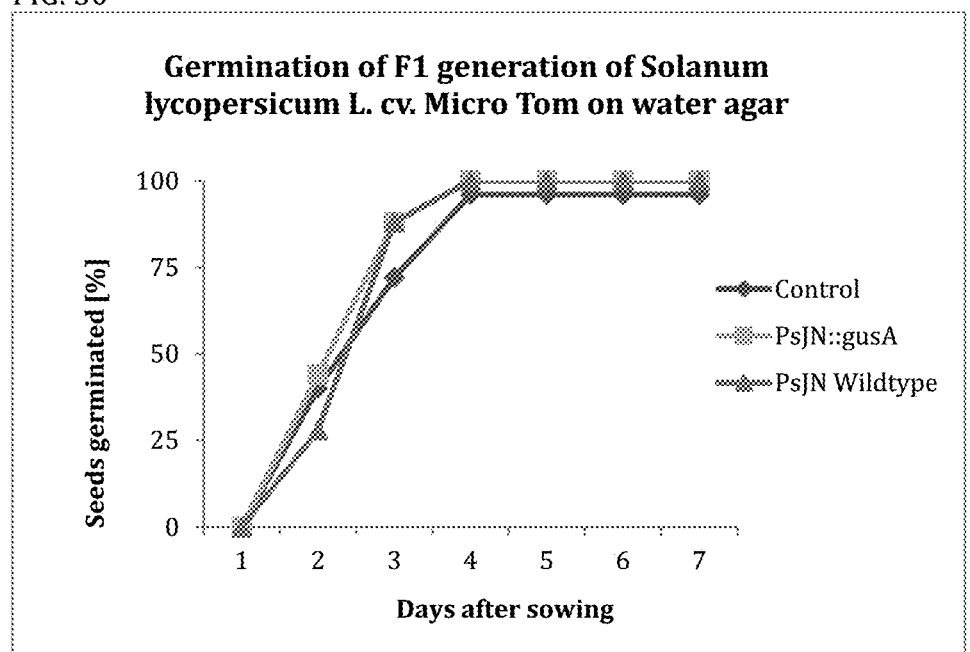
FIG. 30 shows the germination behavior of F1 tomato cv. Micro Tom on water agar. No significant difference in germination behavior can be observed between treatments. All treatments reach a germination rate of 100% (total amount of seeds per plate=25).

Due to low abundance of seed material, the germination experiment with tomato was only conducted on water agar plates (FIGS. 29 and 30). As opposed to pepper, there was no significant difference in development detectable between the treated samples and the control. This observation is in line with the detection of rather low GUS-staining 2 weeks p.i. and indistinguishable frequency/intensity of GUS-staining in the control. This finding illustrates again the fact that flower colonization of PsJN may be a crop- and cultivar-specific matter and has therefore not been as efficient in the case of tomato as in the case of pepper.

Conclusions of Example 14

*Burkholderia phytofirmans* PsJN can be introduced into tomato and pepper seeds and fruits by spraying cells onto flowers.

Example 15

Cultivation-Independent Analysis of Barley and Wheat Seed Communities Based on IGS-Region Amplicon Sequencing After Endophyte Introduction by Flower-Spray To understand whether the endophyte introduced inside of barley and wheat seeds by the flower-spray method described above can be detected, DNA was extracted from the seed and was used to amplify 16s rDNA by PCR. Amplicons were cloned and sequenced.

Experiment Description

Barley and wheat seeds obtained from Example 13, in which flowers of these plants were inoculated with strains *Enterobacter* sp. FD17 and *B. phytofirmans* PsJN were used for this example. Seeds were surface-sterilized with 70% ethanol (3 min), treated with 5% NaOHCl for 5 min, and followed by washing 3 times with sterile distilled water (1 min each time). The efficacy of surface sterilization was verified by plating seed, and aliquots of the final rinse onto LB plates. Samples were considered to be successfully sterilized when no colonies were observed on the LB plates after inoculation for 3 days at 28° C. (Naveed et al., 2013, BMC Complement Altern Med. 2013 13:265).

Surface-disinfected seeds were cut in pieces and crushed using a sterile mortar. The seed material was transferred to Matrix E (MPbio DNA isolation kit from soil) homogenized by 30 sec beat beating using in a bead beater (FastPrep FP 120, Bio101, Savant Instruments, Inc., Holbrook, N.Y.). DNA was extracted with the MPbio DNA isolation kit from soil (MP Biomedicals, Solon, Ohio, USA) according to protocol provided by the manufacturer. A single seed was used for DNA isolation.

Amplifications were performed with a thermocycler (PTC-100™, MJ Research, Inc.) the primers pHr (5'-TGCGGCTGGATCACCTCCTT-3'; SEQ ID 1225)(Massol-Deya et al. 1995) and P23SR01 (5'-GGCTGCTTCTAAGC-CAAC-3'; SEQ ID 1226) (Massol-Deya et al. 1995). PCR-reactions (50 µl total volume) contained 10-30 ng of DNA, 1×PCR reaction buffer (Invitrogen), 1.5 mM $MgCl_2$, 0.2 µM of each primer, 0.2 mM of each deoxynucleoside triphosphate, and 2.5 U Taq DNA polymerase (LifeTech, Vienna, Austria). PCR amplifications were performed with an initial denaturation step for 5 minutes at 95° C., 30 cycles consisting of denaturation for 30 sec at 95° C., primer annealing for 30 sec at 53° C., polymerization for 1 min at 72° C., and completed by a final extension for 10 min at 72° C. PCR products (5 µl) were checked by electrophoresis in 0.8% (w/v) agarose gels (Biozym Biotech Trading, Vienna, Austria).

PCR products were purified by using a QIAquick™ PCR Purification kit (QIAGEN GmbH, Hilden, Germany). DNA fragments were ligated into the vector pSC-A-amp/kan (Strata Clone PCR Cloning Kit, Stratagene, Agilent Technologies, Santa Clara, Calif., USA) and the ligation products were transformed into competent *E. coli* cells (StrataClone SoloPack Competent Cells, Agilent Technologies, Santa Clara, Calif., USA) according to the manufacturer's instructions. One hundred clones per library, appearing as white colonies on indicator plates containing X-Gal (5-bromo-4-chloro-3-indolyl-β-D-galactopyranoside) and IPTG (isopropyl-β-thiogalactopyranoside) were picked, re-suspended in 10 μl sterile water and boiled for 5 min at 95° C. Two μl of the supernatant were used as template for PCR amplification with the primers M13f (5'-TGTAAAACGACGGCCAGT-3'; SEQ ID 1227) and M13r (5'-GGAAACAGCTATGAC-CATG-3', SEQ ID 1228) to amplify cloned inserts. PCR was performed in a total volume of 50 μl and contained in addition to the template DNA, 1×PCR reaction buffer (Invitrogen), 3 mM $MgCl_2$, 0.2 μM of each primer, 0.2 mM of each deoxynucleoside triphosphate, and 2.5 U Taq DNA polymerase (LifeTech, Vienna, Austria). Cycler conditions were as following: 5 min denaturation at 95° C., 30 cycles consisting of denaturation for 30 sec at 95° C., primer annealing for 1 min at 50° C., polymerization for 2 min at 72° C., and final extension for 10 minutes at 72° C. PCR products (5 μl) were checked by electrophoresis in 0.8% (w/v) agarose gels (Biozym Biotech Trading, Vienna, Austria).

Clones were sequenced with the primer M13r making use of the sequencing service of LGC Genomics AGOWA (Berlin, Germany). Retrieved sequences were visualized and vector sequences were removed with sequence alignment editor package of BioEdit (Ibis Biosciences, Carlsbad, Calif., USA). Sequences within a library were dereplicated and grouped using FastGroupII (http://fastgroup.sdsu.edu/fg_tools.htm). For identification representative sequences of each group were subjected to the Basic Local Alignment Search Tool (BLAST) analysis with the National Center for Biotechnology Information (NCBI) database (http://blast.ncbi.nlm.nih.gov/Blast. cgi).

Experiment Results
Wheat and Barley

Sequence analysis of the IGS-region confirmed the presence of *Enterobacter* sp. FD17 and *B. phytofirmans* PsJN. 100% of all sequences obtained after amplification, cloning, and sequencing belonged to the strain used to inoculate the barley and wheat flowers.

Example 16

Introducing *Burkholderia phytofirmans* Strain PsJN into Winter Wheat Seeds

The concept of internal seed colonization with microorganisms tested with the endophytic bacterium *Burkholderia phytofirmans* stain PsJN and a plant variety of winter wheat (*Triticum aestivum* cv. Pannonikus). Strain PsJN was applied by spraying flowering heads on Jun. 7, 2013 in a farmer field near Staasdorf (close to the AIT laboratories in Tulln, lower Austria). In that field, grown with winter wheat cultivar Pannonikus (Austrian variety from the company Saatbau Linz), an area of about 10 $m^2$ was marked and sprayed with a suspension of $10^8$-$10^9$ CFU $mL^{-1}$ (V1). Directly next to that plot, another plot of 10 $m^2$ was marked as control (V2), which was not treated. Both plots were hand-harvested at maturity. Harvested heads were packed separately in bags and brought to Tulln, where they were lab-threshed and stored in separate bags. At maturity, about 25% of all winter wheat seeds analyzed carried PsJN cells. Experiments were performed to determine the effects of internally colonized winter wheat seeds (V1) on offspring plant germination as compared to seed of the same variety, grown next to V1 in the same field during growing season 2013 (V2). In addition, V3 seed (untreated) of the same variety (Pannonikus) was acquired from the breeder before planting in fall 2013. This was to test for any (potentially negative) effects that the usage of "re-grown" seed (V1 and V2 are "re-grown" seed, as the farmer field where V1 and V2 were produced was a grain-production field and not an officially certified seed-production field) might have on the general quality of V1 and V2 trial seed.

Experiment Description

The present invention provides seeds having microorganisms located internally in the seed compartment. Strain PsJN was used as a test strain to test flower inoculation into seeds in a winter wheat cultivar (Pannonikus). Two sets of experiments are designed to: (A) evaluate strain PsJN colonization potential in different tissues of winter wheat plants (particularly grains); and (B) follow-up evaluation of germination, biomass production and yield assays.

Growth of PsJN Strain as Bacterial Inoculum

Figure 31:
FIG. 31. Outdoor generation of seeds colonized with desired endophytes. A), B), C) Contacting winter wheat in the field during flowering with a solution of the heterologous hormone-producing endophyte PsJN to allow uniform colonization of the subsequent seeds.
Figure 31:
Figure 31:
Figure 32:
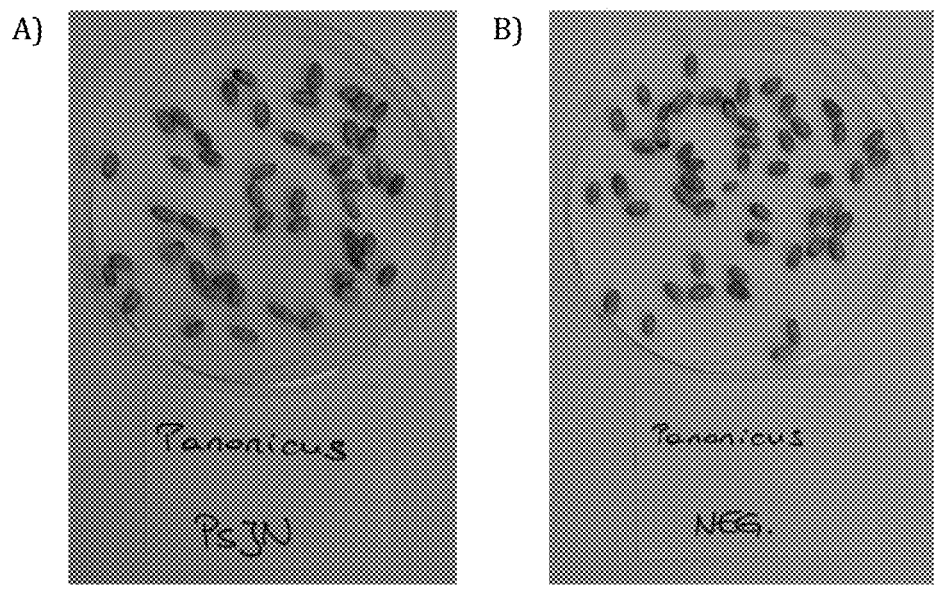
FIG. 32. Successful germination of wheat seeds colonized with heterologous endophytes. A) Appearance of Panonicus variety winter wheat seeds harboring the heterologous hormone-producing endophyte PsJN. Seeds appear slightly larger with normal morphology; B) Control Panonicus variety winter wheat seeds without PsJN; C) Successful germination of Panonicus variety winter wheat seeds harboring the heterologous hormone-producing endophyte PsJN; D) Control Panonicus variety winter wheat seeds without PsJN.
Figure 32:
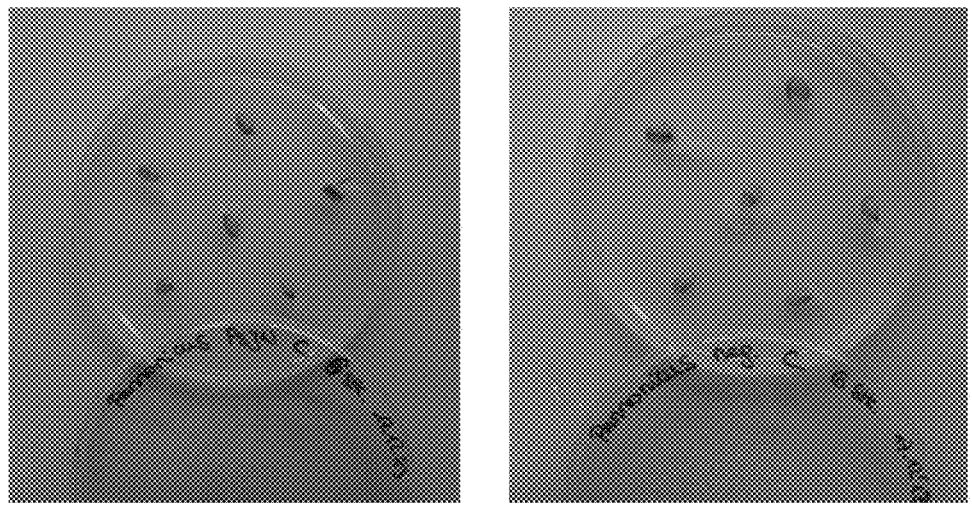
Figure 33:
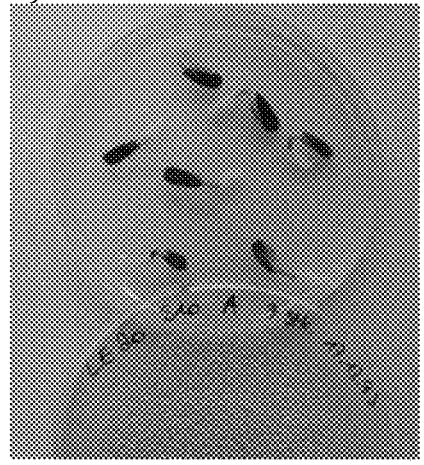
FIG. 33. A) Successful germination of Panonicus variety winter wheat seeds harboring the heterologous endophyte S10; B) Successful germination of Panonicus variety winter wheat seeds harboring the heterologous endophyte PsJN; C) Control Panonicus variety winter wheat seeds without PsJN.
Figure 33:
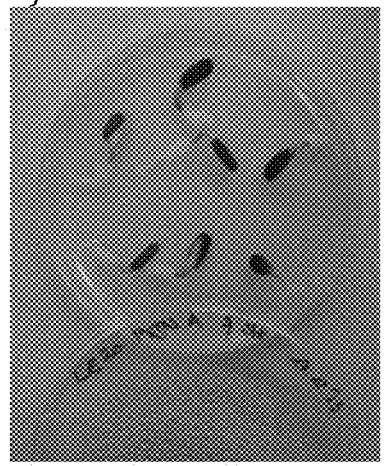
Figure 33:
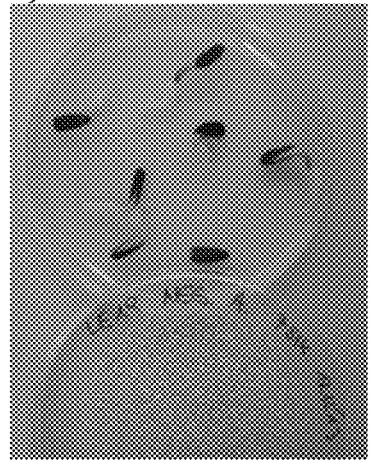
Figure 34:
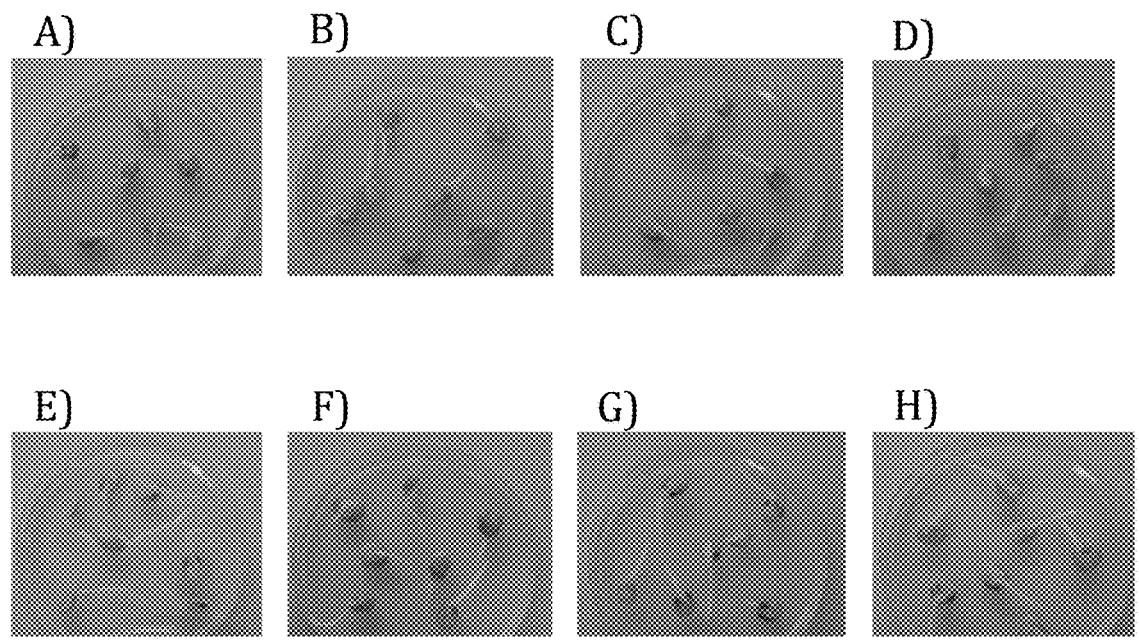
FIG. 34. Successful germination of maize hybrid seeds uniformly containing novel endogenous and heterologous endophytes. A) Successful germination of maize seeds harboring the heterologous endophyte S10. B) Successful germination of maize seeds harboring the endogenous endophyte S4; C) Successful germination of maize seeds harboring the heterologous endophyte PsJN; D) Germination of control maize; E) Successful germination of maize seeds harboring the endogenous endophyte S10; F) Successful germination of maize seeds harboring the endogenous endophyte S4; G) Successful germination of maize seeds harboring the endogenous endophyte PsJN; H) Germination of control maize seeds.

The bacterial strain was grown by loop-inoculating one single colony in LB broth amended with spectinomycin (100 μg $mL^{-1}$) in 100 mL flasks. The bacterial culture was incubated at 28° C. for 2 days at 180 rpm in a shaking incubator. The bacterial inoculum was applied by spraying inoculum at flowering stage using a standard pressure sprayer (max. volume 3.6 L; 0.98 L/min/3 bar), as shown in FIGS. 31a, b, and c. Control plants were sprayed with sterile media. Bacterial inoculum was specifically sprayed to the female flower when the crop reached flowering stage on a 10 $m^2$ plot in a farmer field where they were allowed to mature under standard field conditions and harvested at maturity, i.e., at the same time as the farmer combined the remainder of this field. Seeds obtained from the inoculated flowers (V1) were used for the next set of experiments, as well as the control (V2) from the same farmer field (see FIGS. 32, 33, and 34).

Endophytic Colonization by PsJN Strain (Particularly Grain Colonization)

Prior to the plant experiments, seeds of inoculated flowers as well as control seeds were tested to see whether PsJN cells are present. For this purpose, 24 seeds were surface-sterilized with 70% ethanol (3 min), treated with 5% NaOHCl for 5 min, and followed by washing 3 times with sterile distilled water (1 min each time). The efficacy of surface sterilization was checked by plating seed, and aliquots of the final rinse onto LB plates. Samples were considered to be successfully sterilized when no colonies were observed on the LB plates after inoculation for 3 days at 28° C. Surface-disinfected seeds were cut in pieces and crushed using a sterile mortar. The seed material was transferred to Matrix E (MPbio DNA isolation kit from soil) homogenized by 30 sec beat beating using in a bead beater (FastPrep FP 120, Bio101, Savant Instruments, Inc., Holbrook, N.Y.). DNA was extracted with the MPbio DNA isolation kit from soil (MP Biomedicals, Solon, Ohio, USA) according to protocol provided by the manufacturer. A single seed was used for DNA isolation. For each seed, the IGS region of PsJN was amplified using the pHr primer (Massol-Deya et al. 1995) and one of twenty-four different variants of the IGS forward (P23SR01) primer (Massol-Deya et al. 1995) (IGSFw T1 to T24) containing a 10 bp long overhang (barcode) on the 5'end. PCR amplifications were performed with a thermocycler (PTC-100™, MJ Research, Inc.) using an initial denaturation step of 5 min at 95° C. followed by 30 cycles of 30 s at 95° C., 1 min annealing at 52° C. and 2 min extension at 72° C. PCR reaction mixtures (50 µl) contained 1× reaction buffer (Gibco, BRL), 200 µM each dATP, dCTP, dGTP and dTTP, 2 mM $MgCl_2$ and 2.5 U Taq DNA polymerase (Gibco, BRL), 0.2 µM each of the primers and 1 µl extracted DNA. PCR products were pooled and purified by using a QIAquick™ PCR Purification kit (QIAGEN GmbH, Hilden, Germany). DNA fragments were ligated into the vector pSC-A-amp/kan (Strata Clone PCR Cloning Kit, Stratagene, Agilent Technologies, Santa Clara, Calif., USA) and the ligation products were transformed into competent *E. coli* cells (StrataClone SoloPack Competent Cells, Agilent Technologies, Santa Clara, Calif., USA) according to the manufacturer's instructions. Two hundred clones per library, appearing as white colonies on indicator plates containing X-Gal (5-bromo-4-chloro-3-indolyl-β-D-galactopyranoside) and IPTG (isopropyl-β-thiogalactopyranoside) were picked, re-suspended in 10 µl sterile water and boiled for 5 min at 95° C. Two µl of the supernatant were used as template for PCR amplification with the primers M13f (5'-TGTAAAACGACGGCCAGT-3'; SEQ ID 1227) and M13r (5'-GGAAACAGCTATGACCATG-3'; SEQ ID 1228) to amplify cloned inserts. PCR was performed in a total volume of 50 µl and contained in addition to the template DNA, 1×PCR reaction buffer (Invitrogen), 3 mM $MgCl_2$, 0.2 µM of each primer, 0.2 mM of each deoxynucleoside triphosphate, and 2.5 U Taq DNA polymerase (LifeTech, Vienna, Austria). Cycler conditions were as following: 5 min denaturation at 95° C., 30 cycles consisting of denaturation for 30 sec at 95° C., primer annealing for 1 min at 50° C., polymerization for 2 min at 72° C., and final extension for 10 minutes at 72° C. PCR products (5 µl) were checked by electrophoresis in 0.8% (w/v) agarose gels (Biozym Biotech Trading, Vienna, Austria. Clones were sequenced with the primers M13r and M13f, respectively, making use of the sequencing service of LGC Genomics AGOWA (Berlin, Germany). Retrieved sequences were visualized, vector sequences were removed and sequences assembled with sequence alignment editor package of BioEdit (Ibis Biosciences, Carlsbad, Calif., USA). Sequences within a library were dereplicated and grouped using FastGroupII (http://fastgroup.sdsu.edu/fg_tools.htm). For identification representative sequences of each group were subjected to the Basic Local Alignment Search Tool (BLAST) analysis with the National Center for Biotechnology Information (NCBI) database (http://blast.ncbi.nlm.nih.gov/Blast.cgi).

Germination and Yield

Figures 36, 37:
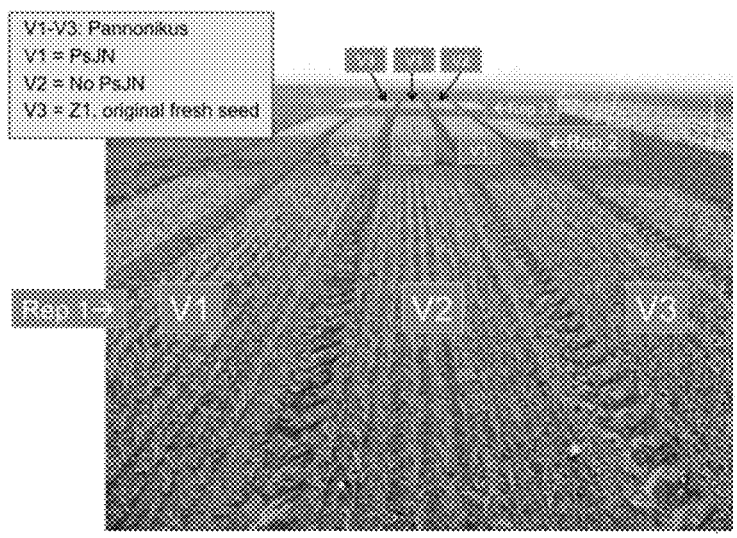
FIG. 36 shows the layout of the winter wheat yield trial near Raasdorf, Lower Austria. V1-V3 are the variety treatments, Border plots are marked as "Border". Numbers in the treatment plots starting "16**" are unique identifiers for each plot.
FIG. 37 shows the winter wheat yield trial near Raasdorf, Lower Austria. V1-V3 grown in a total of 9 plots (V1-V3 denote 3 variety treatments, Rep 1-Rep 3 show 3 replications). As seen on the picture, variety treatments V1-V3 were randomized within each replication. In order to minimize border effect of bordering plots of V1-V3, border plots were grown, 3 to the left and 3 to the right, unmarked in the picture. V1 is planted from seed sprayed with PsJN, V2 is from seed grown as control in the farmer field near Tulbing during 2013. V3 is original seed obtained from the breeder/distributor. V1-V3 are all of the winter wheat cultivar Pannonikus.

Seeds were planted on Oct. 23, 2013 at a field near Raasdorf in Lower Austria, Austria. The layout as well as planting and trial management is standard procedure for such assays and conducted exactly in the same manner as e.g., as seed companies do to test new genetics and as the Official Registration Authorities do in crop registration trials (See FIG. 36). There were 10 rows per plot with a distance of 12 cm between rows. Three replicates of each plot/condition were randomized, as described in FIG. 37. Seeding density was 450 seeds/$m^2$, planting depth was 3-4 cm. Planting was conducted by a small-plot drill planting machine Wintersteiger Plot Seed TC). Fertilizer (standard 120 kg N) was delivered in 3 applications: 1st in spring at EC24, $2^{nd}$ at tiller EC 32, $3^{rd}$ corn filling EC43. Plants were treated with herbicide (Starane, KWIZDA, Austria) once but no fungicide was applied. Plots were harvested on Jul. 21, 2014 with a Wintersteiger Nursery Master harvesting machine. Yield data and agronomic characteristics are summarized in Table 25 and Table 26. Harvest Moisture was measured with the Standard Wintersteiger moisture meter on the harvester (capacitive system), thousand kernel weight (TKW) was determined once per plot by counting kernels on a Contador seed counter and weighing the seeds on a balance. HL weight was measured once per plot making use of a standardized HL volume-cup (¼ liter) and plant height by a meter stick at the time points given in the table. Yield was calculated based on plot fresh weight and harvest moisture and calculated to 14% moisture for all plots.

Results Example 16

Winter Wheat Seed Colonization by Strain PsJN

The ability of strain PsJN to colonize winter wheat seeds was analyzed in plants treated by specific flower inoculation (by spraying), as compared to untreated seeds. Inoculation of flowers resulted in internal colonization of seeds. IGS region-PCR cloning and sequencing resulted in about 90 sequences matching the quality criteria for subsequent analysis each for seeds of PsJN-treated and non-treated plants. After removing chimeric and wheat plastid sequences the PsJN-endoseed library sequences grouped in a total number of 54 sequence groups and 59 groups in case of control seeds. IGS sequences of the PsJN-endoseed library could be assigned to seven different bacterial species with the majority of sequences showed highest homology to *Ralstonia pickettii*. Sequences derived from control seeds originate from seven bacterial species with *Ralstonia pickettii* again being the most dominant species.

The primer tags used for barcoding of single seeds were not evenly distributed within the library of sequences. Out of 24 tags used 16 tags were found again, meaning that we had sequences of 16 individual seeds in the sequence library. The sequences were clustered due to the barcode and within four sequence clusters we found the IGS of *B. phytofirmans* PsJN. Thus, 25% of PsJN-endoseeds contained *B. phytofirmans* PsJN but PsJN was not detected in any of the control seeds.

Effect of PsJN on Termination of Winter Wheat

As described in Table 25, treatment V1 (PsJN inside of the seed) increased the percentage germination average within all three replicates repeats by 10% and 4% when compared to seeds coming from controls V2 and V3, respectively.

In both summer wheat cultivars sprayed with PsJN we found that PsJN-endoseed (V1) yielded 7.5% over the control variety (V3), which was original seed (Z1 seed) of the same variety Pannonikus (Table 26). On the other hand, seed not treated with PsJN but derived from the same field (V2) as PsJN treated seed, yielded below the PsJN treated seed, still higher than the Z1 control. We conclude that yield measurements, as well as data on general agronomics, such as germination and plant height, can be used as surrogates for the presence of endophytes introduced by the endoseed method, just as with endophytes introduced by seed treatment as above.

TABLE 25

Germination was measured by counting a sample of germinating seeds in each plot, and providing data per plot as well as an average of all 3 replications per variety treatment. "% germinated" is the number of germinated seeds divided by the seeding density of 450 seeds/$m^2$.

| Plot | Treatment* | Plants germinated/ $m^2$ | % germinated | Plants germinated/ $m^2$ average | % germinated average |
|---|---|---|---|---|---|
| 1618 | V1 | 382.22 | 84.94 | | |
| 1623 | V1 | 364.44 | 80.99 | 376.38 | 83.62 |

TABLE 25-continued

Germination was measured by counting a sample of germinating seeds in each plot, and providing data per plot as well as an average of all 3 replications per variety treatment. "% germinated" is the number of germinated seeds divided by the seeding density of 450 seeds/m².

| Plot | Treatment* | Plants germinated/ m² | % germinated | Plants germinated/ m² average | % germinated average |
|---|---|---|---|---|---|
| 1625 | V1 | 382.22 | 84.94 | | |
| 1619 | V2 | 333.33 | 74.07 | | |
| 1621 | V2 | 333.33 | 74.07 | 330.37 | 73.42 |
| 1626 | V2 | 324.44 | 72.1 | | |
| 1620 | V3 | 351.11 | 78.02 | | |
| 1622 | V3 | 373.33 | 82.96 | 355.56 | 79.01 |
| 1624 | V3 | 342.22 | 67.05 | | |

*Treatment V1: Sprayed with PsJN in farmer field 2013
V2: Control in farmer field 2013
V3: Original (Z1) seed of the same variety bought in fall 2013 from seed distributor

TABLE 26

Effect of seed colonizing-PsJN on yield and plant height of winter wheat (cv. *Pannonikus*) plants.

| Treatment | Moisture % | HL weight (kg) | TKW (g) | Ave. Plant height (cm) 197 days | Ave. Plant height (cm) 215 days | Ave. Plant height (cm) 271 days | Yield difference to lowest yield |
|---|---|---|---|---|---|---|---|
| V1 | 16.12 | 78.83 | 51.70 | 69.13 | 95.73 | 92.77 | 7.47% |
| V2 | 16.10 | 79.22 | 53.10 | 69.40 | 94.60 | 91.20 | n/a |
| V3 | 15.75 | 77.62 | 51.07 | 71.47 | 94.87 | 92.13 | n/a |

* Treatment V1: Sprayed with PsJN in farmer field 2013
V2: Control in farmer field 2013
V3: Original (Z1) seed of the same variety bought in fall 2013 from seed distributor Conclusions for Example 16

*Burkholderia phytofirmans* PsJN can be introduced into winter wheat seeds by spraying cells onto flowers.

Germination and yield assays can be used as surrogates for the presence of endophytes introduced by the endo-seed method.

Example 17

Production of Endoseeds with Endophytes of Different Taxa and Origin

Experimental Description

In this example, we describe the production of summer wheat (*Triticum aestivum* cvs. Trappe and Kronjet), winter wheat (*Triticum aestivum* cv. Pannonikus), soy (*Glycine max* cvs. Essor and Merlin), and barley (*Hordeum vulgare* cv. Eunova and Calcule) endoseeds colonized by endophytes from different origin and taxonomy (*Burkholderia phytofirmans* PsJN and *Paenibacillus* sp. S10).

Summer wheat and barley endoseed production was as follows: 10 by 1.3 m plots were planted on Mar. 13, 2014 with summer wheat (Trappe and Kronjet cultivars) at a density of 180 kg/ha and barley (Calculae and Eunova) at a density of 150 kg/ha in a field located in Tulln, Austria. Plants got sprayed with herbicide once (Apr. 23, 2014; 1.25 l/ha Andiamo Maxx) and fertilized twice on Apr. 3, 2014. NPK-Fertilzer 16:6:18+5S was applied at a concentration of 300 kg/ha and on May, 9 2014 N-Fertilizer 27% was applied at a concentration of 220 kg/ha. At flowering time, each plot was sprayed twice (wheat: June 4 and Jun. 12, 2014; barley: June 2 and June 10) with one of the treatments as indicated in Table 27.

TABLE 27

Bacterial strains used to spray flowers of summer wheat and barley plants with the aim of introducing the stains into seeds.

| Treatment | Taxonomy | Origin |
|---|---|---|
| S10 | *Paenibacillus* sp. | Maize (cv. PESO) seed |
| PsJN | *Burkholderia phytofirmans* | Onion roots |
| TC38 | *Flavobacterium* sp | Maize (DK315) roots |
| AB | *Aneurinibacillus* sp. | Summer wheat (KWS Collada) seed |
| PsJN + S10 | | |
| Mock (negative control) | | |

The bacterial inoculant used for spraying summer wheat and barley was prepared as follows: endophytes were streaked on large (diameter: 14.5 cm) 20% TSA (Tryptic Soy Agar) plates, grown at 28° C. for 2 days, scraped from the plates and resuspended in 2 L of 1×PBS supplemented with 20 g zeolite (used as a carrier) and 200 µL Silwet L-77 (used as a surfactant) (final OD600 of about 0.1). Suspensions were filled into spraying bottles and each plot was sprayed with 1 L of the corresponding treatment. For the simultaneous application of PsJN and S10 1 L bacterial suspension each was prepared as described above and mixed carefully before adding zeolite and the surfactant. Negative control plots were sprayed with 1×PBS containing zeolite and Silwet. Only 10 whole spikes per plot were harvested for further colonization analysis. Remaining plants were harvested, threshed and stored.

Winter wheat PsJN endoseed production was as follows: two 10 m² plots were planted with winter wheat (Pannonikus cultivar) seeds at a density of 180 kg/ha in a field located in Tulln, Austria. One plot was sprayed with *B. phytofirmans* PsJN and the second plot used as an untreated control.

The bacterial inoculant used for spraying winter barley was prepared as follows: 10 mL of 10% TSB (Tryptic Soy Broth) were inoculated with a single colony of *B. phytofirmans* PsJN and incubated at 28° C. and shaking overnight. The culture was then transferred to 200 mL 10% TSB and incubated at 28° C. and shaking for 24 h. This culture was transferred to 2.4 L 10% TSB and incubated at 28° C. and shaking for an additional 24 h. The bacterial culture was adjusted to an $OD_{600}$ of 0.5 yielding in 3.5 L of bacterial suspension. 24 g of zeolite was added and mixed in the suspension right before spraying. Wheat flowers were sprayed on Jun. 7, 2014 until covered by a grey film of zeolite.

Both plots were harvested manually yielding about 10 kg each. The ears were threshed with a standard lab threshing. 10 ears per treatment were kept intact for the analysis of variations on single ears.

Soy endoseed production was as follows: eighty soy seeds of each variety (Merlin and Essor cultivars) were sown into a mixture of Einheitserde special—Topfsubstrat ED 63 and perlite in a proportion of 5:3 in a greenhouse chamber at the AIT in Tulln, Austria. Ten days after sowing 55 seedlings each were individually potted into 1 L (12×12×12 cm) pots containing substrate as described above. Plants were watered automatically twice a week by flooding for 10 min. Plants were fertilized once with 3% "Wuxal Super". At flowering time, each pot was sprayed three times (30, 35 and 39 days after sowing) with one of the treatments as indicated in Table 28. Each treatment was applied on ten plants per cultivar.

TABLE 28

Bacterial strains used to spray flowers of soy plants with the aim of introducing the stains into seeds.

| Treatment | Taxonomy | Origin |
| --- | --- | --- |
| S10 | *Paenibacillus* sp. | Maize (cv. PESO) seed |
| PsJN | *Burkholderia phytofirmans* | Onion roots |
| TC38 | *Flavobacterium* sp | Maize (DK315) roots |
| NC92 | *Bradyrhizobium japonicum* | |
| Mock (negative control) | | |

The bacterial inoculant used for spraying soy was prepared as follows: 5 ml trypic soy broth (10%) were inoculated with single colonies of endophytes and incubated overnight at 28° C. in a rotary shaker. 5 overnight cultures per endophyte were pooled and cells harvested by centrifugation at 4,700 rpm and room temperature. The supernatant was discarded and the pellet resuspended in 1×PBS buffer to a final OD 0.2 (about 25 ml). Suspensions were filled into 50 ml-nebulizers and used to spray 20 plants.

Endophytic Colonization by PsJN Strain (Particularly Grain Colonization)

Quantification of PsJN in endoseeds from summer wheat, winter wheat, barley and soy was determined with qPCR. Seeds were surface-sterilized by soaking the seeds in 70% ethanol for 3 min followed by 5% sodium hypochloride for 5 min, and washed three times with sterile distilled water (1 min for each wash). Seeds and aliquots of the final wash were plated on LB plates to verify the efficiency of surface sterilization. Seeds were considered to be successfully sterilized when no colonies were observed on the LB plates after inoculation for 3 days at 28° C. Single surface-sterilized seeds were aseptically peeled using a scalpel, cut in pieces and crushed using a sterile mortar. Seed material was homogenized for 30s in lysing matrix E (MPbio DNA isolation kit from soil) using in a bead beater (FastPrep FP 120, Bio101, Savant Instruments, Inc., Holbrook, N.Y.). DNA was then extracted with the MPbio DNA isolation kit from soil (MP Biomedicals, Solon, Ohio, USA) according to protocol provided by the manufacturer.

For quantification of *Burkholderia phytofirmans* PsJN, the obtained DNA from the isolation steps was used to perform a quantitative real time PCR using a Taqman probe and a Biorad CFX96 real-time detection system. The probe was designed in a previous study to match the DNA amplicon (transcription termination factor rho) produced by the primers 1824 Forward and 1824 Reverse (Bphyt_1824 Fw and Re). The sequence of the forward primer was AAAAACGAGCCAAAAGGGC (5'→3'), SEQ ID 1229, the sequence of the reverse primer was CGTTAT-TTCGCGCTGGTG (5'→3'), SEQ ID 1230. The sequence of this probe was AAACCTCGTACCTCGCCAGC (5'→3'), SEQ ID 1377. The probe is equipped with a FAM (6-FAM-phosphoramidit—fluorescent dye) on the 5' end, and a BHQ-1 (Black hole quencher 1) on the 3' end. A BioRad SsoFast Probe Supermix was used to provide the ideal conditions for the probe during the PCR.

For qPCR standard preparation, chromosomal DNA of *B. phytofirmans* PsJN was isolated using FastDNA™ SPIN Kit for soil (MP Biomedicals, LLC) according the manufacter protocol. DNA concentration was determined using a Nanotrop and doing five replicate measurements. The mean value was used for further calculations. The number of DNA copies was calculated as follows:

$$\text{number of copies} = \frac{\text{DNA quantity}\left(\frac{g}{\mu l}\right)}{\text{fragment length} * 660 \text{ g/mol}} * 6{,}022 * 10^{\wedge}23$$

where fragment length is 8214658 bp (size of PsJN genome). A dilution series was prepared to generate a standard curve.

Detection of PsJN in Soy Plant Tissue (Seeds) using DOPE-FISH

For microscopy analysis, plant samples were used and cut in small parts (0.5-cm long sections). Samples were then fixed overnight at 4° C. in a paraformaldehyde solution (4% in PBS pH 7.2), and rinsed twice in PBS. Treatment with a lysozyme solution (1 mg mL$^{-1}$ in PBS) was then applied to the samples for 10 min at 37° C. before being dehydrated in an ethanol series (25, 50, 75 and 99.9%; 15 min each step). Fluorescence in situ hybridization using double labeling of oligonucleotide probes (DOPE-FISH) was carried out using probes from Eurofins (Germany) labeled at both the 5' and 3' positions. An EUBmix (equivalent mixture of EUB338, EUB338II, EUB338III) coupled with a ATT0488 fluorochrome (Amann et al. (1990), Nature reviews microbiology 6: 339-348; Daims et al. (1999), *Syst Appl Microbiol* 22: 434-444), and a probe for *B. phytofirmans* coupled with Cy5 were used (probe B. phyt unpublished, created by S. Compant based on 23S rRNA gene sequence and probe design; as described in Example 3). NONEUB probe (Wallner et al. (1993), *Cytometry* 14: 136-143) coupled with Cy5 or ATT0488 was also used independently as a negative control. Hybridization was carried out at 46° C. for 2 h with 10-20 µL solution (containing 20 mM Tris-HCl pH 8.0, 0.01% w/v SDS, 0.9 M NaCl, formamide at the concentration suited to the probe, and 10 ng µL$^{-1}$ of each probe) applied to each plant sample placed on slides in a 50-mL moist chamber (also housing a piece of tissue imbibed with 5 mL hybridization buffer). Washing was conducted at 48° C. for 30 min with a post-FISH pre-warmed solution containing 20 mM Tris-HCl pH 8.0, 0.01% (w/v) SDS, 5 mM EDTA pH 8.0 and NaCl at a concentration corresponding to the formamide concentration. Samples were then rinsed with distilled water before air drying for at least 1 day in the dark. The samples were then observed under a confocal microscope (Olympus Fluoview FV1000 with multiline laser FV5-LAMAR-2

HeNe(G)laser FV10-LAHEG230-2). X, Y, Z pictures were taken at 405, 488, 633 nm and then merged (RGB) using Image J software. Z Project Stacks was then used to create the pictures (as described in Campisano et al. (2014), *Mol Biol Evol* 31: 1059-1065)).

Results from Example 17

Seed Colonization by Strain PsJN Analyzed by qPCR

The results summarized in Tables 29 and 30 show that *B. phytofirmans* PsJN could be successfully introduced into seeds of summer wheat, soy and winter wheat by spraying the flowers of the parent plants.

In both summer wheat cultivars sprayed with PsJN we found the strain to be effectively introduced into the seeds—21 (Trappe) or 22 (Kronjet) out of 24 seeds, respectively were tested positive in PsJN specific qPCR assays (up to 92% of wheat seeds were colonized by PsJN upon spraying of parent flowers). The PsJN cell number per seed varied strongly and reached up to 28000 in selected samples (cv. Kronjet). Simultaneous application of *B. phytofirmans* PsJN with another bacterial strain (*Paenibacillus* sp. S10) was less efficient. Only seeds of cultivar Kronjet were colonized by PsJN with 13 out of 24 analyzed seeds being positive in PsJN specific qPCR and the cell number within seeds ranged between 100 and 2000.

PsJN was not found in seeds of barley plants sprayed with the strain. However, we found PsJN in the respective negative controls. Two out of 24 seeds of both barley cultivars tested contained PsJN. In this context, it needs to be explained that summer wheat and barley endoseeds were produced in one field. When the plants were sprayed (twice during flowering) the weather conditions were extremely windy and the spray solutions were distributed across the plots. Taking this into account cross contaminations were to be expected. The cell number in the PsJN-colonized cells of the negative control however was relatively low ranging between 120 and 190 cells per seed.

To exclude the possibility that PsJN is naturally occurring in wheat and barley seeds used to produce endoseeds in the field original seeds/seeds of the parental generation were tested with the PsJN-specific qPCR. No signal was found in any of the tested seed samples.

Winter wheat (cv. Pannonikus) endoseeds were produced in a field. PsJN was not detected in the seeds derived from the not treated field plot or the original seeds bought from the producer but two out of 24 (8%) seeds of sprayed plants gave a positive signal in PsJN specific qPCR.

In the case of soy the endoseed production was done in the greenhouse and no cross-contamination during spray application of *B. phytofirmans* PsJN occurred. The negative control did not give a positive signal PsJN specific qPCR. The colonization efficiency was different in the two soy cultivars tested. Two out of twelve (17%) seeds of cultivar Merlin contained PsN cells whereas six out of 12 (50%) seeds of cultivar Essor were found to harbor PsJN. The two soy cultivars tested differ in the maturity, with Essor being early maturing (00) and Merlin very early maturing (000). The flowers of both cultivars were sprayed at the same day. Differences in the developmental stage of flowers could thus have influenced the susceptibility of soy flowers to invading PsJN cells. The number of PsJN cells detected in soy seeds (based on qPCR) ranged from about 360 to about 4500 cells per seed.

TABLE 29

(a) Number of seeds colonized by PsJN out of sample size indicated and range of numbers of copies of PsJN within colonized seeds. PsJN identification was done by qPCR.

| Plant species | Negative control* | | Original seed (parental generation, untreated)# | |
|---|---|---|---|---|
| | Colonized/ tested seeds | copies per seed | Colonized/ tested seeds | copies per seed |
| Summer wheat (Trappe) | 0/24 | 0 | 0/3 | 0 |
| Summer wheat (Kronjet) | 15/24 | 1.7E+2 to 7.2E+03 | 0/3 | 0 |
| Barley (Calucle) | 2/24 | 1.2E+02 to 2.4E+02 | 0/3 | 0 |
| Barley (Eunova) | 2/24 | 1.9E+02 to 2.69E+02 | 0/3 | 0 |
| Soy (Merlin) | 0/24 | 0 | n.d. | n.d. |
| Soy (Essor) | 0/24 | 0 | n.d. | n.d. |
| Winter wheat (Pannonikus) | 0/24 | 0 | 0/8 | 0 |

*Control in field or greenhouse
Original seed of the same variety

TABLE 30

(a) Number of seeds colonized by PsJN out of sample size indicated and range of numbers of copies of PsJN within colonized seeds.

| | PsJN* | | PsJN + S10# | |
|---|---|---|---|---|
| | Colonized/ tested seeds | copies per seed | Colonized/ tested seeds | copies per seed |
| Summer wheat (Trappe) | 21/24 | 2.66E+02 to 6.88E+03 | 0/24 | 0 |
| Summer wheat (Kronjet) | 22/24 | 4.7E+02 to 2.8E+04 | 13/24 | 1.23E+02 to 1.98E+03 |
| Barley (Calucle) | 0/24 | 0 | 0/24 | 0 |
| Barley (Eunova) | 0/24 | 0 | 0/24 | 0 |
| Soy (Merlin) | 2/12 | 3.66E+02 to 1.64E+03 | n.d. | n.d. |
| Soy (Essor) | 6/12 | 7.29E+02 to 4.50E+03 | n.d. | n.d. |
| Winter wheat (Pannonikus) | 2/24 | 1.5E+02 to 7.6E+02 | n.d. | n.d. |

Figure 38:
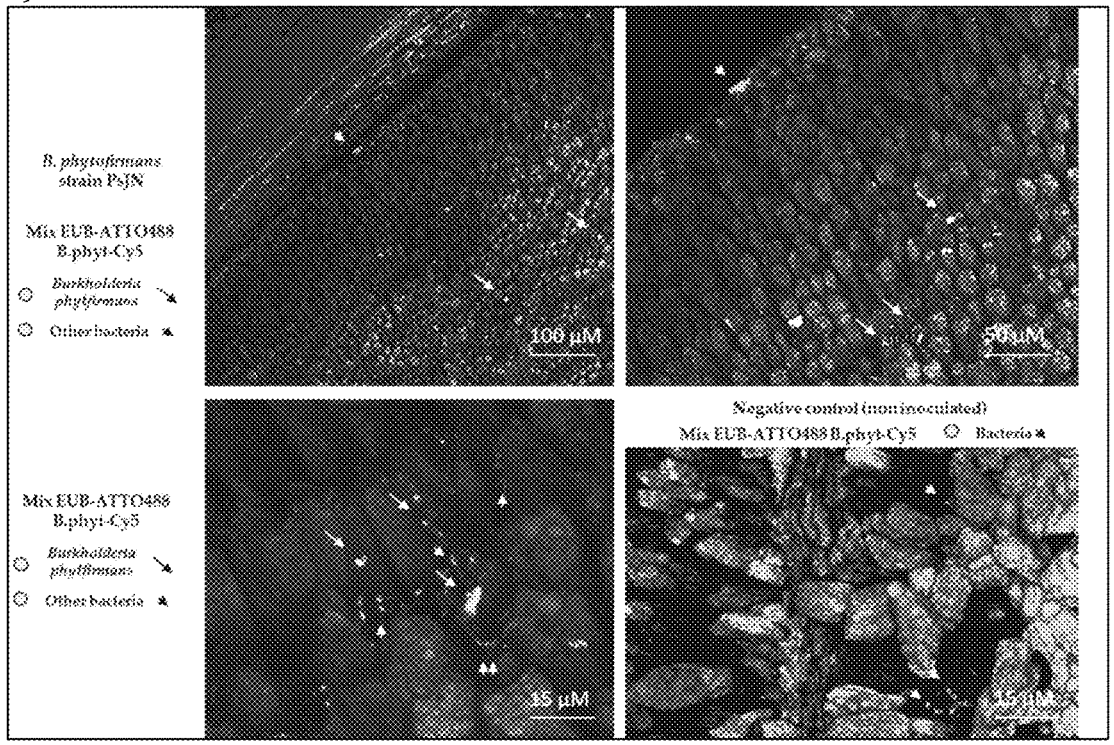
FIG. 38 shows microphotographs of DOPE-FISH-confocal microscopy A) shows cells of *B. phytofirmans* (yellow) among native bacteria (green) in soy seeds and native bacteria in control seeds. B) shows results using NONEUB probes in soy seed colonized by *B. phytofirmans* PsJN or control seeds.
Figure 38:
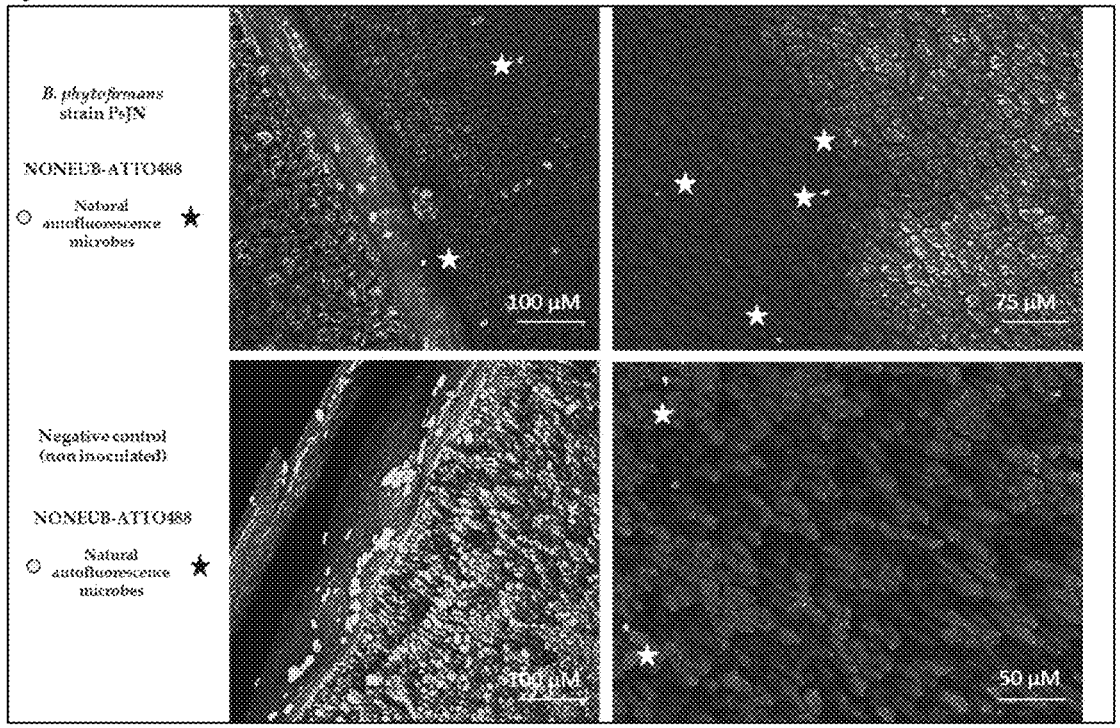

*sprayed with *B. phytofirmans* PsJN in field or greenhouse
sprayed simultaneously with *B. phytofirmans* PsJN and *Paenibacillus* sp. S10 in field or greenhouse Detection of PsJN in Soy Plant Tissues (Seeds) Using FISH Yellow fluorescent bacteria PsJN were found inside the embryo of soy PsJN-endoseed along with a very large amount of other unknown bacteria (green fluorescence), which also colonized the seed coat (FIG. 38A), while in control seeds only the native bacteria are present (green fluorescence). FIG. 38B shows that by using NONEUB probe only a few native autofluorescent microbes can be detected inside the embryo of seeds colonized by PsJN and in control seeds.

Conclusions for Example 17

*Burkholderia phytofirmans* PsJN can be introduced into seeds of winter wheat, summer wheat, barley and soy seeds by spraying cells onto flowers of parent plants to produce plant bioreactors. *B. phytofirmans* PsJN can be introduced into seeds of monocotyledons (as shown in this example for wheat and barley) as well as dicotyledons (as shown in this example for soy). PsJN colonizes soy seeds and is located within the embryo of soy seeds. *B. phytofirmans* PsJN can be introduced into seeds together with another bacterium upon spraying flowers of parent plants.

Example 18

Analysis of Microbial Communities of Endoseed Prepared in the Field

To determine the presence and abundance of the endophyte with which endoseed was prepared, DNA was extracted from the endoseed and was used to amplify 16S rDNA using the following method.

Experiment A: Illumina Sequencing on Germinated Endoseeds

Experimental Description

Endoseeds were prepared as in Example 17. 16S rDNA amplicon sequencing (MiSeq, Illumina) was performed on the following samples: 1. summer wheat Trappe control, 2. summer wheat Trappe PsJN, 3. summer wheat Trappe PsJN+S10, 4. summer wheat Trappe S10, 5. summer wheat Trappe TC38, 6. summer wheat Trappe AB, 7. summer wheat Kronjet control, 8. summer wheat Kronjet PsJN, 9. summer wheat Kronjet PsJN+S10, 10. summer wheat Kronjet S10, 11. summer wheat Kronjet TC38, 12. summer wheat Kronjet AB, 13. barley Calcule control, 14. barley Calcule PsJN, 15. barley Calcule PsJN+S10, 16. barley Calcule S10, 17. barley Calcule TC38, 18. barley Calcule AB, 19. barley Eunova control, 20. barley Eunova PsJN, 21. barley Eunova PsJN+S10, 22. barley Eunova S10, 23. barley EunovaTC38, 24. barley Eunova AB.

Genomic DNA was isolated based on FastDNA® SPIN Kit for soil as described above and all gDNA were adjusted to 5 ng/µl. A nested PCR approach was used to amplify bacterial 16S rDNA from DNA isolated of wheat and barley seeds. The first amplification was performed with primers 799for and 1392rev (Chelius and Triplett, 2001) with standard reaction parameters.

Twenty-five µl of the 16S rDNA PCR amplicons were subjected to electrophoresis (100V for 1 h) in 2% (w/v) TBE agarose gels (Biozym Biotech Trading, Vienna, Austria). Amplification with the primer pair 799F and 1392R allows exclusion of the amplification of chloroplast 16S rDNA and results in co-amplification of bacterial and mitochondrial ribosomal genes with the mitochondrial amplicon being about 1000 bp long whereas the bacterial band is about 600 bp. The band of interest containing the PCR-product of bacterial 16S rDNA was excised. The gel pieces were put in a filter tip that was placed in a fresh tube and DNA was collected by centrifugation for 2 min at 1000 rpm. The eluate was collected.

The second amplification was performed with the primers 799 for_illumina and 1175 R1_illumina, harboring the primer binding site for the Illumina indexing primers at the 5'-end using standard amplification reaction procedures as known in the art.

Twenty-five µl of the 16S rDNA PCR amplicons were subjected to electrophoresis (100V for 1 h) in 2% (w/v) TBE agarose gels (Biozym Biotech Trading, Vienna, Austria). The 500 bp bands were cut and gel pieces were put in a filter tip that was placed in a fresh tube and DNA was collected by centrifugation for 2 min at 1000 rpm. The eluate was collected.

Index PCR was performed with Nextera XT Index Kit (24 indices, 96 samples) (Illumina Inc., San Diego, USA) according to the manufacturers protocol.

In order to purify the amplicon away from free nucleotides and primers and primer dimer species before quantification we used AMPure XP beads following the manufacturer's protocol strictly.

Amplicon concentration has been measured using a Nanodrop and about 10 ng per sample were pooled. DNA quality and quantity of the pooled library was tested with an Agilent 2100 Bioanalyzer. The final amplicon size was about 570 bp including the adapter, sequencing primer binding site and index on both sides.

The library denaturing, addition of internal control DNA (PhiX, Illumina) and sample loading were done according to the Illumina protocol.

16S rDNA sequences processing was done as follows: The raw reads were screened for PhiX contamination using Bowtie2 (B. Langmead et al. (2012), *Nat. Methods*. vol. 9, no. 4, 357-359.) and data quality was checked in FASTQC (http://www.bioinformatics.babraham.ac.uk/projects/fastqc/). Overlapping reads were merged with PEAR (J. Zhang et al. (2014) *Bioinformatics*, vol. 30, no. 5, pp. 614-620, March 2014. and then labeled and pooled in QIIME (J. G. Caporaso et al. (2010) *Nat. Methods, vol.* 7, no. 5, pp. 335-336). Sequences were de-replicated, sorted and noisy filtered in vsearch (https://github.com/torognes/vsearch). Chimeras were removed using both a de novo and a reference based approach with UCHIME (R. C. Edgar et al. (2011) *Bioinforma. Oxf. Engl., vol.* 27, no. 16, pp. 2194-2200). The ChimeraSlayer's database was used as a gold standard for the reference based chimera checking (B. J. Haas et. al. (2011) *Genome Res.*, vol. 21, no. 3, pp. 494-504). OTU picking was accomplished in vsearch with the pairwise identity percentage of 0.97 and cluster centroid sequences aligned against the whole read pool using a full dynamic programming algorithm (Needleman-Wunsch) for global sequence alignment (T. Rogne, et al. (2011) *BMC Bioinformatics, vol.* 12, no. 1, p. 221). Taxonomy assignment was performed employing the naïve Bayesian RDP classifier with a minimum confidence of 0.8 (Q. Wang et al. (2007) *Appl. Environ. Microbiol.*, vol. 73, no. 16, pp. 5261-5267) against the last version of the Greengenes database (08/2013) (D. McDonald et al. (2012) *ISME J.* vol. 6, no. 3, pp. 610-618).

Overall shifts in bacterial community composition were assessed using non-metric multidimensional scaling and permutational multivariate analysis of variance. These analyses were based on a Bray-Curtis dissimilarities calculated from square-root transformed OTU observation counts. To compensate for differences in the number of sequences per sample, 1000 sequences were randomly taken from each sample to use in these analyses. Prior to analysis, OTUs without phylum level classifications were removed as an additional quality control measure.

To assess shifts in the relative abundances of individual taxa, mean relative abundances were calculated for each wheat cultivar and each treatment or control samples. These relative abundances were compared using a mixed effects model applied to each taxon in an automated R script (R Core Team 2013). For this model, cultivar was treated as a random effect while the treatment was treated as a fixed effect. Relative abundances were rank transformed prior to fitting the models. The models were calculated using the 'nlme' package in R. To control for potentially spurious OTUs, only OTUs represented by at least 1 sequence (i.e. 0.1% of the sequences), on average, were included in the analysis.

In addition, changes in the relative abundances of OTUs representing the strains used in the Endoseed treatments were assessed. This analysis was conducted by identifying these OTUs which were classified to the same genus as the strains used in the experimental treatments. The relative abundance of these OTUs were compared across controls and treatments.

Experimental Results Experiment A

Figure 39:
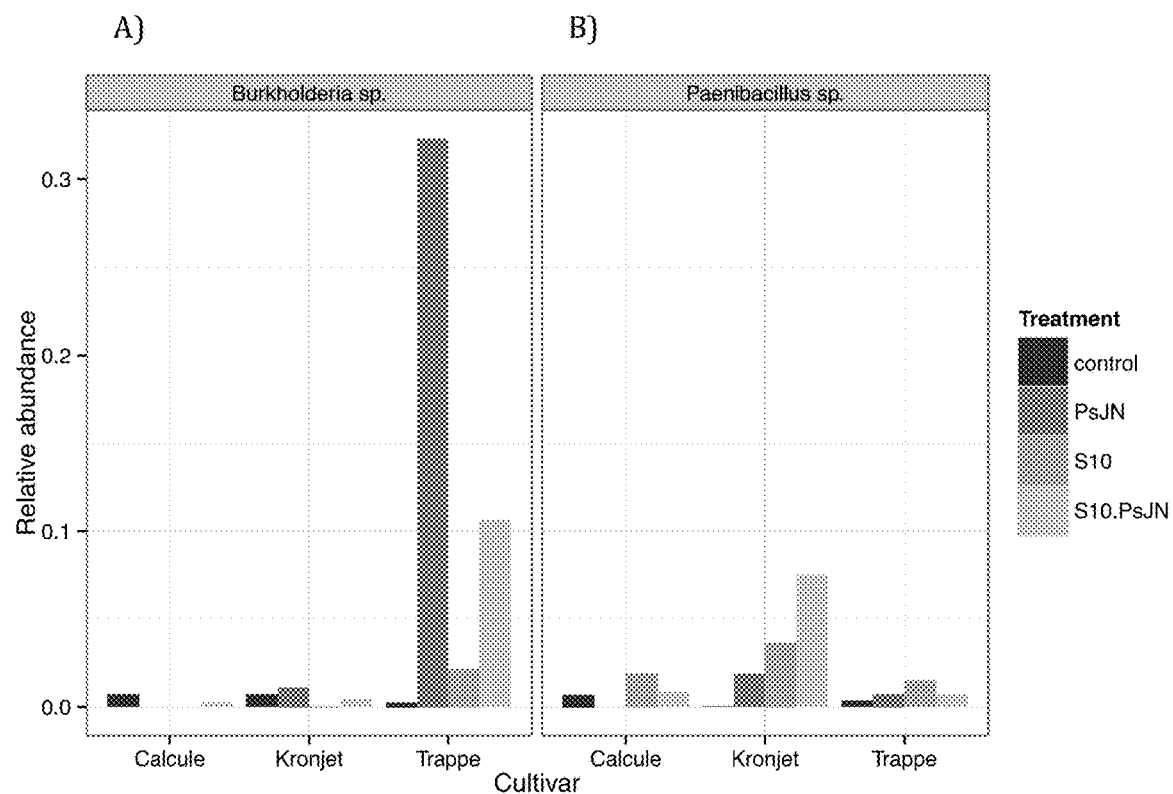
FIG. 39 shows the relative abundance of the PsJN (*Purkholderia* sp) and S10 (*Paenibacillus* sp.) in endoseeds treated with these endophytes, in summer wheat (*Triticum aestivum* cvs. Trappe and Kronjet) and barley (*Hordeum vulgare* cv. Calcule).
Figure 40:
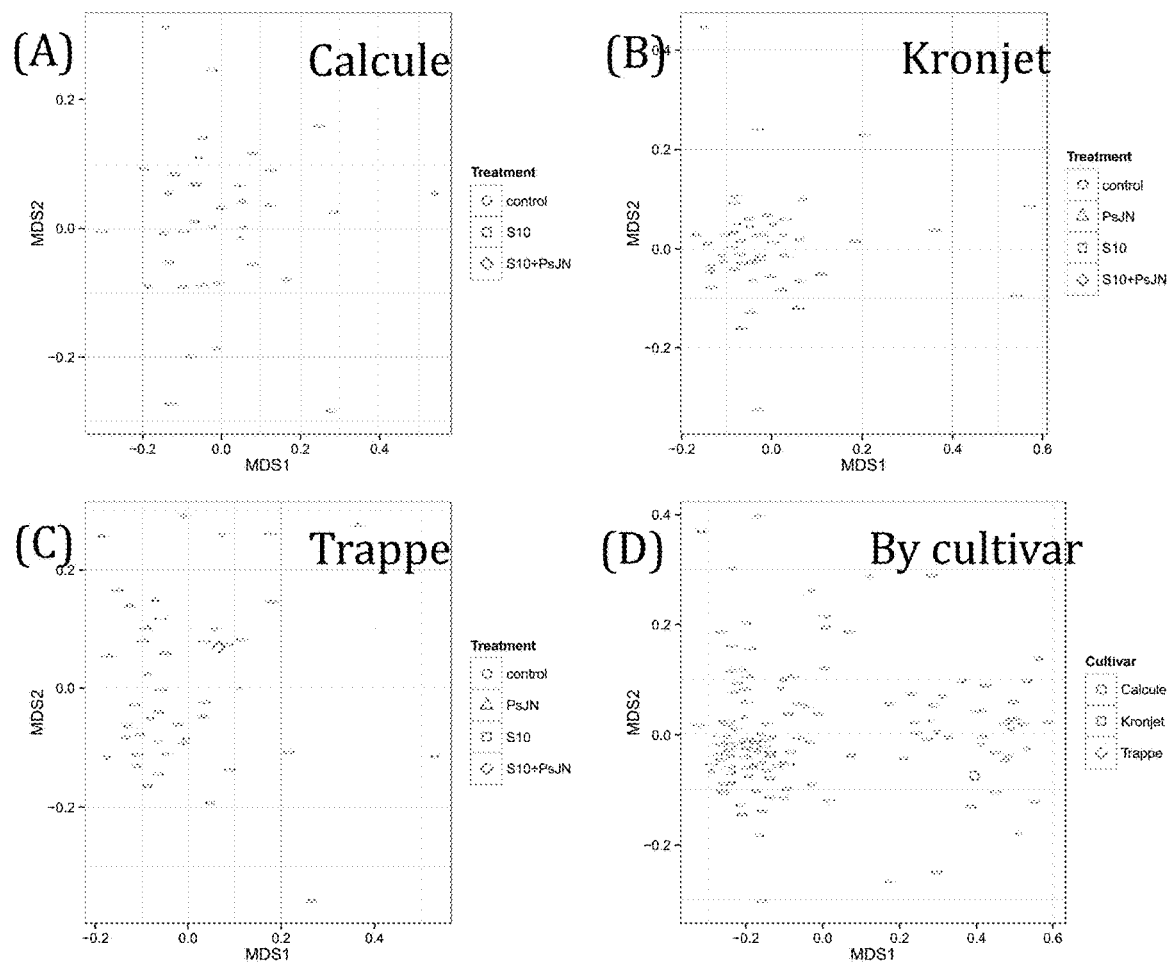
FIG. 40 shows a shift in the bacterial communities in endoseed treated with PsJN, S10, PsJN+S10 in the Kronjet (B) and Trappe (C) summer wheat varieties, but not in the Calcule (A) barley variety. Panel (D) shows that distinct bacterial communities live within seeds of the four varieties tested.

Deep amplicon sequencing of partial 16S rDNA of single endoseeds allowed identification of DNA of strain PsJN and S10 in summer wheat and barley seeds (FIG. 39). FIG. 40 shows that in the Kronjet and Trappe summer wheat varieties, the PsJN, S10, and PsJN+S10 treatments led to a shift in the bacterial communities in the endoseeds. Panel (D) shows that distinct bacterial communities live within seeds of the four varieties tested, as expected.

Looking at the level of the individual taxa, these sequencing indicated that, apart from taxa belonging to the *Paenibacillus* and the Burkholderiaceae families, there were shifts in other families of bacteria. The following bacteria appeared following treatment with endophytes: Kineosporiaceae, Weeksellaceae, Geodermatophilaceae, Bacillaceae, Thermicanus, Weeksellaceae, Geodermatophilaceae. The Chitinophagaceae and Alcaligenaceae families disappeared. A number of families were less abundant in endoseeds: Actinomycetaceae, Chitinophagaceae, Phyllobacteriaceae, Microbacteriaceae, Exiguobacteraceae, Sphingomonadaceae, Phyllobacteriaceae. The abundance of the Comamonadaceae and Xanthomonadaceae families increased with endoseed treatment.

Conclusion Experiment A

Bacterial strains of different phylogenetic background and ecological origin could be introduced into seeds of summer wheat and barley by spraying bacterial formulations on flowers of parent plants. Endoseed of summer wheat and barley carrying both, gram-positive (*Paenibacillus* sp. S10) and gram-negative (*B. phyotfirmans* PsJN, *Flavobacteium* sp, TC38) bacteria could be generated.

Experiment B: Sanger Sequencing on Germinated Endoseeds

Experimental Description

The following endoseeds were used for this experiment: soy (Essor and Merlin) treated with sterile broth, PsJN or NC92, summer wheat (Kronjet and Trappe) treated with sterile broth, PsJN, S10, PsJN+S10 or *Aneurinibacillus* sp, AB and winter wheat (Pannonikus) treated with sterile broth or PsJN. Twenty seeds for each of these endoseed treatments and their corresponding controls were surface sterilized using chlorine gas, except for soybean, where only 6 seeds were used. All surface sterilized seeds were germinated on water agar plates in the dark at room temperature. As soon as they germinated, 5 healthy seedlings per treatment (2 for soybean) were transferred into an empty, sterile water agar filled glass jar and incubated at 25 C for 7 days. Using sterile forceps, intact seedlings were pulled out of the jars and placed (roots and shoots together) into a clean 50 mL conical tube. 3 mL of sterile water and 3 carbide beads were added per tube, and the tube was agitated at 6 M vibrations/sec for 60 seconds in a Fastprep machine. 150 uL of the resulting slurry was transferred into an Eppendorf tube for extraction using a MoBio PowerPlant® Pro-htp 96 Well DNA Isolation Kit. Bacterial populations were studied through amplication of the V5, 6, 7 and 8 regions of the 16S rRNA gene using the chloroplast excluding primer 799F and 1492R. Amplicons were run on a 1% agarose gel and 700 bp fragments cut out to separate them from mitochondrial bands. These bacterial 16S bands were put into TOPO TA cloning vectors, transformed into *E. coli* and the resulting libraries sequenced by Genewiz (Cambridge, Mass.). Genewiz randomly picked 50 clones per rep, amplified them by rolling circle amplification, then conducted Sanger sequencing using T3 primers. Sequences were processed and annotated in batches by Geneious™ software (Biomatters Limited, Auckland, New Zealand).

Results Experiment B

Figure 41:
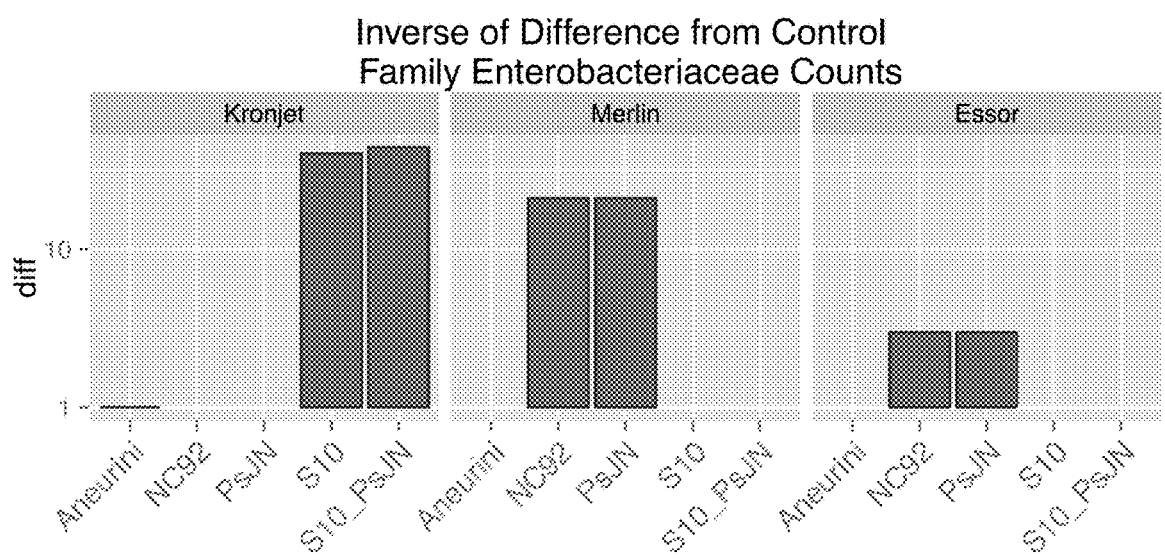
FIG. 41 shows a decrease of bacteria of the *Enterobacter* family within synthetic combinations of the plants and bacterial endophytes. In summer wheat (Kronjet), treatment with S10 and S10+PsJN, resulted in a decrease of bacteria of the *Enterobacter* family. Treatment of the Essor and Merlin soy varieties with NC92 and PsJN similarly caused a decrease of bacteria of the *Enterobacter* family.

From this experiment, the *Enterobacter* family was the only family of bacteria that showed sufficient counts from the Sanger sequencing to be able to do a reliable analysis, and this only in the Kronjet summer wheat variety and the Essor and Merlin soy varieties. In summer wheat (Kronjet), treatment with S10 and S10+PsJN, resulted in a decrease of bacteria of the *Enterobacter* family within the synthetic combinations of the wheat plants and bacterial endophytes (FIG. 41). Note that FIG. 41 shows the inverse of the difference, meaning that a decrease is represented as a positive bar. In both soy varieties, treatment with NC92 and PsJN caused a decrease of bacteria of the *Enterobacter* family.

Conclusion for Experiment B

The generation of seeds containing endophytes resulted in a decrease of bacteria of the *Enterobacter* family within the synthetic combinations of the plants and bacterial endophytes.

Example 19

Proteomic Analysis

In order to explore the pathways augmented or otherwise modified by the bacteria in the endoseeds, we performed proteomic analysis on extracts of wheat, maize and soy plants grown from endoseeds. As in Example 9 above, the changes in protein levels in the endoseed or a plant grown from the endoseed can be used as a surrogage for determination of the presence of an endophyte within a bioreactor.

Experimental Description

Endoseeds were prepared as in Example 17, and the following samples were used for proteomic measurements (Table 31).

TABLE 31

Samples used for proteomic measurements.

| Sample # | Crop | Cultivar | Treatment |
|---|---|---|---|
| 1 | Winter wheat | Pannonikus | untreated |
| 2 | Winter wheat | Pannonikus | mock |
| 3 | Winter wheat | Pannonikus | PsJN |
| 4 | Summer wheat | Trappe | untreated |
| 5 | Summer wheat | Trappe | mock |
| 6 | Summer wheat | Trappe | S10 |
| 7 | Summer wheat | Trappe | PsJN |
| 8 | Summer wheat | Kronjet | untreated |
| 9 | Summer wheat | Kronjet | mock |
| 10 | Summer wheat | Kronjet | PsJN |
| 11 | Summer wheat | Kronjet | *Aneurinibacillus* sp. |

After 7 days of growth on water agar, 12 whole seedlings (including roots, seeds and hypocotyls) per treatment were collected in a 50 mL falcon tube using sterile forceps and immediately snap-frozen in liquid nitrogen to minimize protein degradation and proteomic changes during sample collection (such as wound responses from using the forceps). The frozen samples were then homogenized using a pestle and mortar previously cooled in liquid nitrogen and transferred to a 15 mL falcon tube on dry ice. The homogenized samples were stored at −80° C. until further processing.

1 mL of 5% SDS 1 mM DTT was added to 1 mL of homogenized tissue and the samples were boiled for 5 m. The samples were cooled on ice and 2 mL of 8M urea solution was added. The samples were spun for 20 m at 14,000 rpm and the soluble phase recovered. A 25% volume of 100% TCA solution was added to the soluble phase, left on ice for 20 m and centrifuged for 10 m at 14,000 rpm. The protein pellet was washed twice with ice-cold acetone and solubilized in 125 µL 0.2M NaOH and neutralized with 125 µL of 1M Tris-Cl pH 8.0. Protein solutions were diluted in THE (50 mM Tris-Cl pH8.0, 100 mM NaCl, 1 mM EDTA) buffer. RapiGest SF reagent (Waters Corp., Milford, Mass.) was added to the mix to a final concentration of 0.1% and samples were boiled for 5 min. TCEP (Tris (2-carboxyethyl) phosphine) was added to 1 mM (final concentration) and the samples were incubated at 37° C. for 30 min. Subsequently, the samples were carboxymethylated with 0.5 mg ml$^{-1}$ of iodoacetamide for 30 min at 37° C. followed by neutralization with 2 mM TCEP (final concentration). Proteins samples prepared as above were digested with trypsin (trypsin:protein ratio of 1:50) overnight at 37° C. RapiGest was degraded and removed by treating the samples with 250 mM HCl at 37° C. for 1 h followed by centrifugation at 14,000 rpm for 30 min at 4° C. The soluble fraction was then added to a new tube and the peptides were extracted and desalted using Aspire RP30 desalting columns (Thermo Scientific). The trypsinized samples were labeled with isobaric tags (iTRAQ, ABSCIEX, Ross et al 2004), where each sample was labeled with a specific tag to its peptides.

Each set of experiments (samples 1-6; 7,8; 9-12; 13-16; 17-20) was then pooled and fractionated using high pH reverse phase chromatography (HPRP-Xterra C18 reverse phase, 4.6 mm×10 mm 5 µm particle (Waters)). The chromatography conditions were as follows: the column was heated to 37° C. and a linear gradient from 5-35% B (Buffer A-20 mM ammonium formate pH10 aqueous, Buffer B-20 mM ammonium formate pH10 in 80% ACN-water) was applied for 80 min at 0.5 ml min$^{-1}$ flow rate. A total of 30 fractions of 0.5 ml volume where collected for LC-MS/MS analysis. Each of these fractions was analyzed by high-pressure liquid chromatography (HPLC) coupled with tandem mass spectroscopy (LC-MS/MS) using nano-spray ionization. The nanospray ionization experiments were performed using a TripleTOF 5600 hybrid mass spectrometer (AB SCIEX Concord, Ontario, Canada)) interfaced with nano-scale reversed-phase HPLC (Tempo, Applied Biosystems (Life Technologies), CA, USA) using a 10 cm-180 micron ID glass capillary packed with 5 µm C18 Zorbax™ beads (Agilent Technologies, Santa Clara, Calif.). Peptides were eluted from the C18 column into the mass spectrometer using a linear gradient (5-30%) of ACN (Acetonitrile) at a flow rate of 550 µl min$^{-1}$ for 100 min. The buffers used to create the ACN gradient were: Buffer A (98% H$_2$O, 2% ACN, 0.2% formic acid, and 0.005% TFA) and Buffer B (100% ACN, 0.2% formic acid, and 0.005% TFA). MS/MS data were acquired in a data-dependent manner in which the MS1 data was acquired for 250 ms at m/z of 400 to 1250 Da and the MS/MS data was acquired from m/z of 50 to 2,000 Da. For Independent data acquisition (IDA) parameters MS1-TOF 250 ms, followed by 50 MS2 events of 25 ms each. The IDA criteria, over 200 counts threshold, charge state +2-4 with 4 s exclusion. Finally, the collected data were analyzed using Protein Pilot 4.0 (AB SCIEX) for peptide identifications and quantification.

Experimental Results

Synthetic combinations of wheat plants and bacterial endophytes (PsJN, *Aneurinibacillus* sp. and S10) grown under normal conditions produce a proteomic signature including polypeptides associated with growth promotion, resistance against stress and mechanisms involved in symbiosis enhancement (Tables 33, 34, and 35). Changes in the levels of these proteins within a plant bioreactor may be indicative of the presence of an endophyte.

TABLE 32

Proteins involved in growth promotion showing differential levels of expression in winter and summer wheat germinated seeds relative to not-inoculated control germinated seeds.

| | Growth Promotion | | | | |
|---|---|---|---|---|---|
| Accession | | | | Treatment | |
| number | Gene name | Function | PsJN | *Aneurinibacillus* sp. | S10 |
| gi\|473753353 | 40S ribosomal protein S19 | Developmental regulation in endosperm | + | | |
| gi\|473882607 | Hypothetical protein TRIUR3_30538 | Similar to bacterial chromosome segregation | | + | |
| gi\|474259811 | Elongation factor 1-gamma 2 | Upregulated in cotyledons during development | | | + |

+, upregulated compared to control;

−, downregulated compared to control

TABLE 33

Proteins involved in resistance against abiotic stress showing differential levels of expression in winter and summer wheat germinated seeds relative to not-inoculated control germinated seeds.

| | Resistance Against Abiotic Stress | | Treatment | | |
|---|---|---|---|---|---|
| Accession number | Gene name | Function | PsJN | *Aneurinibacillus* sp. | S10 |
| gi\|473886243 | 60S ribosomal protein L26-1 | Upregulated in soy under flooding stress | | | + |
| gi\|473890451 | T-complex protein 1 subunit beta | Upregulated in soy under flooding stress | | + | |
| gi\|473970552 | Heat shock 70 kDa protein, mitochondrial | Upregulated in wheat under nitrogen stress | | + | |
| gi\|474154141 | Adenosylhomocysteinase | Regulated in wheat in response to Hg exposure | + | | + |
| gi\|474188401 | Enolase | Upregulated in wheat in response to drought | | + | + |
| gi\|474302864 | Putative calcium-binding protein CML7 | Downregulated in ascorbate-primed wheat seeds during germination under salt stress | − | | |
| gi\|474431297 | V-type proton ATPase catalytic subunit A | Energy generation for transport of ions (salt and water stress response in barley colonized with *Piriformospora indica*) | | | + |
| gi\|474438538 | RuBisCO large subunit-binding protein subunit beta, chloroplastic | Upregulated in common bean in response to drought stress | | + | |
| gi\|209944123 | putative phospholipase D alpha 1 precursor | Mediated signal transduction/Upregulated in Chinese cabbage under dessication stress | + | | |
| gi\|473901576 | 60S ribosomal protein L19-2 | Regulated in wheat in response to Hg exposure | | | |
| gi\|474135678 | 26S proteasome non-ATPase regulatory subunit RPN12A | Upregulated in seedling roots of salt tolerant soybean in responses to salinity stress | + | | |
| gi\|474416088 | Elongation factor 2 | Downregulation in *Medicago truncatula* under water deficit | + | | |

+, upregulated compared to control;
−, downregulated compared to control

TABLE 34

Proteins involved in symbiosis defense or establishment showing differential levels of expression in winter and summer wheat germinated seeds relative to not-inoculated control germinated seeds.

| | Symbiosis Defense or Establishment | | Treatment | | |
|---|---|---|---|---|---|
| Accession number | Gene name | Function | PsJN | *Aneurinibacillus* sp. | S10 |
| gi\|1346344 | Keratin, type II cytoskeletal 6A | Infection structure development | | | + |
| gi\|473790174 | 60S ribosomal protein L14-1 | Response to *Burkholderia phytofirmans* | + | | |
| gi\|473742212 | 60S ribosomal protein L18-2 | Response to *Burkholderia phytofirmans* | | | − |
| gi\|474186081 | 40S ribosomal protein S15a-1 | Response to *Burkholderia phytofirmans* | + | | |
| gi\|473970549 | Aspartate aminotransferase, cytoplasmic | Response to bacterial ACC deaminase | | | + |

TABLE 34-continued

Proteins involved in symbiosis defense or establishment showing differential levels of expression in winter and summer wheat germinated seeds relative to not-inoculated control germinated seeds.

| | Symbiosis Defense or Establishment | | Treatment | | |
|---|---|---|---|---|---|
| Accession number | Gene name | Function | PsJN | *Aneurinibacillus* sp. | S10 |
| gi\|474200923 | Luminal-binding protein 3 | Pathogen response in barley | + | | + |
| gi\|474247591 | ATP synthase subunit alpha, mitochondrial | Upregulated in symbiotically colonized orchid | + | | + |
| gi\|474250318 | Phosphoenolpyruvate carboxylase 2 | Upregulated in transgenic pest resistant oranges | + | | + |
| gi\|474258378 | Calreticulin | Upregulated in sweetclover symbiotic with *Sinorhizobium meliloti* | + | + | |
| gi\|474369382 | Nucleoside diphosphate kinase 1 | Upregulated in rice infected with bacteria | | | + |
| gi\|474384893 | Putative lipoxygenase 3 | Symbiotic nodule formation | + | | |
| gi\|474388024 | Elongation factor 1-alpha | Upregulated in cells harboring arbuscular mycorrhiza | + | | |
| gi\|474449989 | Glyceraldehyde-3-phosphate dehydrogenase, cytosolic 3 | Upregulated in cell walls in response to symbiotic elicitors | | | + |
| gi\|386848 | keratin | Regulated in cell walls during nodulation | − | − | + |
| gi\|473930078 | 40S ribosomal protein S4 | Regulated in response to mycorrhiza | − | | |
| gi\|473935893 | Actin-depolymerizing factor 4 | Similar to rice OslecRK, involved in immune response and seed germination | | | − |
| gi\|473939759 | Stromal 70 kDa heat shock-related protein, chloroplastic | Upregulated in tomato in response to a protective strain of *Fusarium oxysporum* | | | + |
| gi\|473970552 | Heat shock 70 kDa protein, mitochondrial | Upregulated in soybean root hairs after infection by *Bradyrhizobium japonicum* | + | | |
| gi\|473987280 | Aldehyde dehydrogenase family 2 member B7, mitochondrial | Upregulated in *Brassica napus* guard cells in response to *Brassica napus* | + | | − |
| gi\|473993048 | UTP-glucose-1-phosphate uridylyltransferase | Upregulated by salicylic acid treatment on sweet cherry fruits in the presence of pathogens | | | − |
| gi\|473993302 | 5-methyltetrahydropteroyltri-glutamate--homocysteine methyltransferase | Regulated in sugarcane in response to the endophytic plant-growth-promoting bacterium *Gluconacetobacter diazotrophicus* | | | + |
| gi\|474040032 | Chaperonin CPN60-2, mitochondrial | Sulfenylated in *Medicago truncatula* during symbiosis with *Sinorhizobium meliloti* | − | | |
| gi\|474077243 | ADP, ATP carrier protein, mitochondrial | Upregulated in perennial ryegrass colonized with the endophytic fungus *Neotyphodium lolii* | | | + |
| gi\|474086745 | 60S ribosomal protein L8 | Downregulated in common bean roots symbiotic with compatible bacteria | | | − |
| gi\|474094006 | 1-Cys peroxiredoxin PER1 | Pathogenesis related protein; regulated during germination and seedling growth of chickpea under suboptimal soil-water conditions | − | | |

TABLE 34-continued

Proteins involved in symbiosis defense or establishment showing differential levels of expression in winter and summer wheat germinated seeds relative to not-inoculated control germinated seeds.

| | Symbiosis Defense or Establishment | | Treatment | | |
|---|---|---|---|---|---|
| Accession number | Gene name | Function | PsJN | *Aneurinibacillus* sp. | S10 |
| gi\|474113969 | RuBisCO large subunit-binding protein subunit alpha, chloroplastic | Sulfenylated in *Medicago truncatula* during symbiosis with *Sinorhizobium meliloti* | + | | |
| gi\|474299793 | 40S ribosomal protein S11 | Downregulated in oak microcuttings inoculated with the ectomicorrhiza *Piloderma croceum* | − | | |
| gi\|474440867 | 60S ribosomal protein LI0-2 | Upregulated in wheat leaves inoculated with pathogenic powdery mildew | | | − |

+, upregulated compared to control;
−, downregulated compared to control

Conclusion for Example 19

Changes in the levels of the proteins shown in Tables 32, 33, and 34 within a plant bioreactor may be indicative of the presence of an endophyte.

Example 20

Germination Rate of Endoseeds Prepared in the Field

The ambition of this germination assay was to find out if there is a difference in germination and growth between endoseeds and non-treated seeds of summer wheat (*Triticum aestivum* cvs. Trappe and Kronjet) or barley (*Hordeum vulgare* cvs. Eunova and Calcule) inoculated with *Burkholderia phytofirmans* (PsJN), *Flavobacterium* sp. (TC38), *Paenibacillus tundrae* (S10), a mixture of *Paenibacillus* sp. S10 and *Burkholderia phytofirmans* (S10+PsJN) or *Aneurinibacillus* sp. AB. As stated above, germination assays may be used as surrogate assays for the presence of endophytes within a plant bioreactor.

Experimental Description

Endoseeds were prepared as in Example 17. Seeds were put on filter paper strips, moistened with Milli-Q-water. Another moistened filter paper strip was put on top of it. Both stripes, with the seeds in-between, were rolled up. The rolls were put into an airtight plastic container for germination and to keep them moist. The rolls were opened up daily for regular rating of the state of germination and the germination rate was scored starting on day 1 until day 4, except the germination was rated only until day 3, as the germination was finished by then. The germination state was determined on a scale of 0 to 5 for wheat as follows: "0" is no germination; "1" corresponds to germination, first root tip visible; "2" corresponds to three little roots and a first little shoot visible; "3" corresponds to a light green shoot; "4" corresponds to a green shoot at least 1 cm in length; "5" corresponds to a green shoot at least 2 cm in length. For barley, germination state was determined on a scale of 0 to 7 as follows: "0" is no germination; "1" corresponds to germination, first root tip visible; "2" corresponds to two to three little roots and a first little shoot visible; "3" corresponds to a light green shoot; "4" corresponds to a green shoot at least 1 cm in length; "5" corresponds to a green shoot at least 2 cm in length; "6" corresponds to tip of leaf being visible; "7" corresponds to leaf being visible for at least 2 cm.

Apart from germination seedling growth was determined by measuring the length of the main root and the shoot with a ruler on day 4.

Experimental Results

Figure 42:
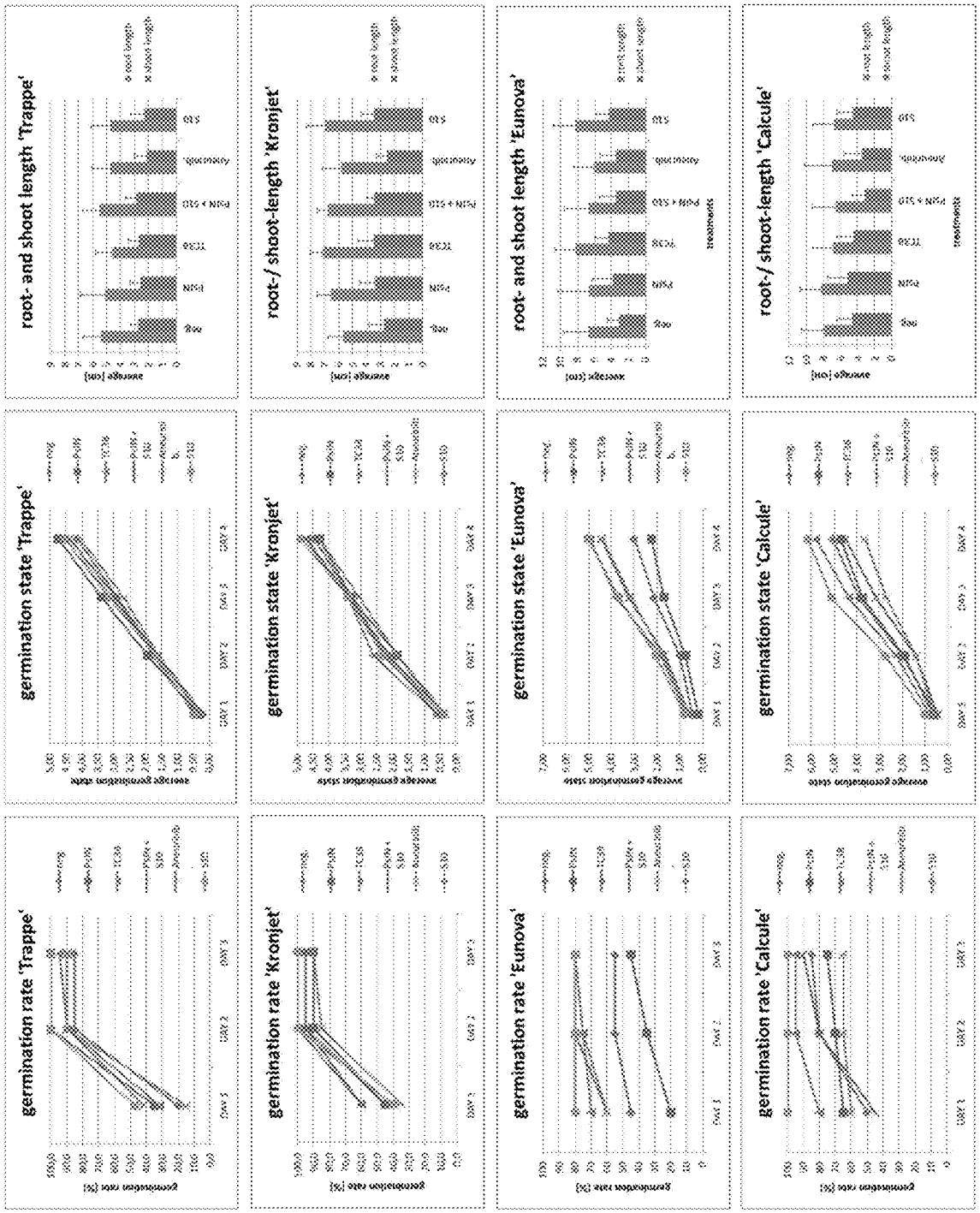
FIG. 42 shows the germination rate [% of seeds germinated], germination state and root- and shoot length of seedlings of endoseed and control seeds of summer wheat (*Triticum aestivum* cvs. Trappe and Kronjet) and barley (*Hordeum vulgare* cv. Eunova and Calcule) endoseeds colonized by endophytes from different origin and taxonomy.

In this experiment the effect of bacteria of different phylogeny and origin introduced into seeds of summer wheat and barley on seed germination and seeding growth has been tested. PsJN, TC38 and S10 endoseeds of summer wheat cultivar Trappe showed increased germination rate as compared to control seeds. Eighty-five % of control seeds germinated whereas 100% of PsJN- and S10-endoseeds and 95% of TC38-endoseeds were germinated after three days FIG. 42). No effect on germination time and seedling growth was found in cultivar Trappe and no effect on any of the tested parameters was found in cultivar Kronjet. Barley seeds responded stronger to the incorporated bacteria than the wheat seed. Effects were found for germination rate, germination time and seedling length (FIG. 42). Four strains and combinations (TC38, S10, S10+PsJN, and AB) increased germination rate and germination time of barley cv. Eunova. Fifty-five % of control seeds germinated whereas 80% of endoseeds treated with the abovementioned strains was fully germinated within three days. Accordingly, the development of seedling of these endoseeds was also faster than in the control seeds. In addition, seedling emerging from TC38 and S10-endoseeds of cultivar Eunova showed increased root and shoot length (FIG. 42). In the barley cultivar Calcule only strain S10 had a positive effect on germination rate and time. After three days 100% of S10-endoseeds were germinated whereas 85% of control seeds were germinated. The development of S10-endoseed seedlings was faster than that of control seeds or any other endoseeds. No effect was found on root and shoot length Calcule seedlings.

Conclusion for Example 20

Bacterial strains introduced into seeds upon spraying flowers of parent plants had a stimulating effect on seed germination and seedling growth in summer wheat and barley. Both, gram-positive (S10, AB) and gram-negative (TC38) bacteria were found to be able to increase germination and seedling growth in summer wheat and barley when introduced into the seeds. Strains of different origin were able to increase germination and seedling growth of summer wheat (PsJN isolated from onion roots, TC38 isolated from maize roots, S10 isolated form maize seeds) and of barley (TC38, S10 and AB isolated from summer wheat).

Example 21

Effect of PsJN Incorporated into Wheat (*Triticum aestivum* cv. Trappe) Seeds (Endoseed) or Coated on Seeds (Exoseed) on Plant Growth and Spike Onset This greenhouse test was conducted to determine the difference in germination, growth and flower onset between summer wheat (*Triticum aestivum* cv. Trappe) growing out of (1) seeds internally carrying *Burkholderia phytofirmans*, (2) seeds coated with PsJN and (3) not treated control seeds.

Experimental Description

Endoseeds and control seeds were prepared in a field in 2014 as in Example 9. The colonization of endoseeds by strain PsJN has been tested prior to this experiment. Eighty-eight % of the seeds carried PsJN cells at a detectable level ($10^2$ to $10^3$ copies per seed). The following treatments were used in this experiment:

summer wheat cv. Trappe PsJN endoseed later named Endo summer wheat cv. Trappe control seeds coated with PsJN later named Exo summer wheat cv. Trappe control seeds treated with sterile broth For the preparation of bacterial inoculum for seed coating single colonies of *Burkholderia phytofirmans* PsJN were used to inoculate 3 glass tubes filled with 5 mL sterile 10% tryptic soy broth and bacteria were grown over night at 28° C. on a rotary shaker at 200 rpm. Glass tubes filled with sterile broth only were carried along as negative control to ensure that the broth used was sterile. At the flowing day (Oct. 3, 2014), the bacterial suspensions were pooled and adjusted to a concentration of $5\times10^8$ cfu/mL with 10% tryptic soy broth. Summer wheat seeds were incubated with the bacterial suspension (about 15 mL) in petri dishes (Ø 60 mm) for two hours. EndoSeeds and control seeds were inoculated in 15 mL of sterile 10% tryptic soy broth in petri dishes (Ø 60 mm) for two hours, to make sure all seeds have the same start value of nutrients due to the medium.

After inoculation each batch of 24 moist seeds was sown in multipot plates with a single pot diameter of 5.5 cm and a depth of 6 cm containing pot soil (Einheitserde special—Topfsubstrat ED 63). Trays were watered with tap water.

Regular rating of germination rate was conducted on a daily basis starting on day 3 until day 10. During this period plants were still in multipot plates. From day 11 onwards only height was measured as germination was finished.

On day 17, six plants per treatment were potted individually in pots with a diameter of 15 cm, containing pot soil (Einheitserde special—Topfsubstrat ED 63). Height was measured once a week until day 69. From day 48 forward, the number of tillers was also counted once per week. The appearance of the first spike per plant was monitored between Dec. 4, 2014 and Dec. 15, 2014. The day on which first spike on the first plant was observed (Dec. 4, 2014) was rated with 1, and subsequent days were rated in ascending order, i.e. if the first spike on a particular plant was observed on Dec. 7, 2014, the plant was rated with a 4. Accordingly the lower the overall value the sooner the spike appeared.

Experimental Results

Figure 43:
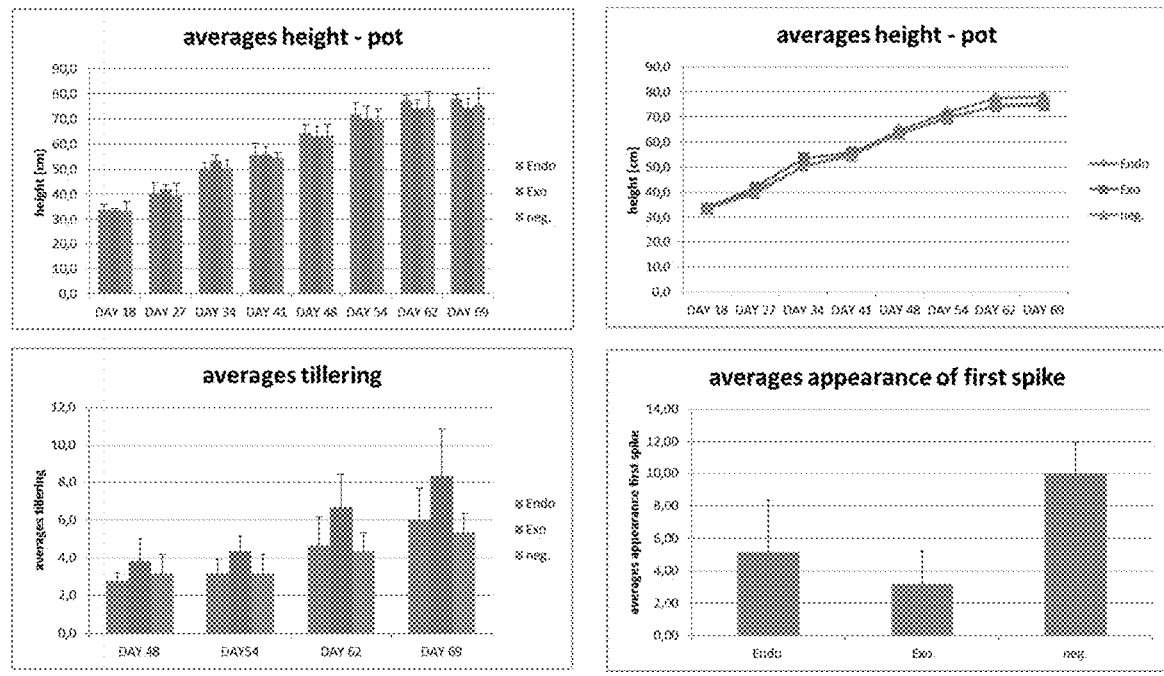
FIG. 43 shows the effect of PsJN incorporated into summer wheat (*Triticum aestivum* cv. Trappe) seeds (endoseed) or coated on seeds (exoseed) on seed plant growth, tillering and spike onset as compared to control plants.

Strain PsJN had no effect on plant growth in summer wheat (*Triticum aestivum* cv. Trappe) irrespectively of whether it was internally colonizing the seeds ("Endo") or applied as seed coating ("Exo") (FIG. 43). Tillering was increased upon PsJN treatment whereby the application as a seed coating was more effective than the PsJN-endoseeds. Both seed treatments with PsJN reduced remarkably the time until spike onset. On average the spikes of plants emerging from PsJN-endoseeds appeared five days earlier than of control plants. This effect was even more pronounced in plants emerging from seeds coated with PsJN where the spikes appeared seven days earlier than in the control plants. In this context it needs to be taken in account that the cell number of PsJN in endoseeds was most probably lower ($10^2$ to $10^3$ copy numbers per seed) than in the seed coating ($10^8$ CFU/mL) applied. Moreover, about 88% of endoseeds were colonized by PsJN whereas 100% of Exo-seeds were treated with PsJN.

Conclusion for Example 21

Regardless of the method by which the endophyte is introduced into the plant bioreactor (seed coating or endoseed), determination of the developmental time for spike formation of the plant can be used as surrogate assay to determine the presence of the endophyte within the bioreactor.

Example 22

Determination of Colonization Rates of Individual Endoseeds of the Same Head

The purpose of this experiment is to determine the extent of colonization of endoseeds from different locations on a spike for summer wheat cultivar Trappe, and the colonization rate of individual seeds from a soybean pod. In each case, the endoseed was generated using *Burkholderia phytofirmans* (PsJN).

Experiment Description

Endoseeds and control seeds were prepared in a field in 2014 as in Example 9. At time of harvest ten individual heads per treatment were harvested.

Endoseeds used in this experiment:

Summer wheat cv. Trappe treated with *Burkholderia phytofirmans* PsJN

Summer wheat cv. Trappe treated with steril buffer

Quantification of PsJN in endoseeds was achieved by strain specific qPCR. Seeds were surface-sterilized by soaking the seeds in 70% ethanol for 3 min followed by 5% sodium hypochloride for 5 min, and washed three times with sterile distilled water (1 min for each wash). Seeds and aliquots of the final wash were plated on LB plates to verify the efficiency of surface sterilization. Seeds were considered to be successfully sterilized when no colonies were observed on the LB plates after inoculation for 3 days at 28° C. Single surface-sterilized seeds were aseptically peeled using a scalpel, cut in pieces and crushed using a sterile mortar. Seed material was homogenized for 30 s in lysing matrix E (MPbio DNA isolation kit from soil) using in a bead beater (FastPrep FP 120, Bio101, Savant Instruments, Inc., Holbrook, N.Y.). DNA was then extracted with the MPbio DNA isolation kit from soil (MP Biomedicals, Solon, Ohio, USA) according to protocol provided by the manufacturer.

For quantification of *Burkholderia phytofirmans* PsJN, the obtained DNA from the isolation steps was used to perform a quantitative real time PCR using a Taqman probe and a Biorad CFX96 real-time detection system. The probe was designed in a previous study to match the DNA amplicon (transcription termination factor rho) produced by the primers 1824 Forward and 1824 Reverse (Bphyt_1824 Fw and Re). The sequence of the forward primer was AAAAACGAGCCAAAAGGGC (5'→3'), SEQ ID 1229, the sequence of the reverse primer was CGTTAT-TTCGCGCTGGTG (5'→3'), SEQ ID 1230. The sequence of this probe was AAACCTCGTACCTCGCCAGC (5'→3'), SEQ ID 1231. The probe is equipped with a FAM (6-FAM-phosphoramidit—fluorescent dye) on the 5' end, and a BHQ-1 (Black hole quencher 1) on the 3' end. A BioRad SsoFast Probe Supermix was used to provide the ideal conditions for the probe during the PCR.

For qPCR standard preparation, chromosomal DNA of *B. phytofirmans* PsJN was isolated using FastDNA™ SPIN Kit for soil (MP Biomedicals, LLC) according the manufacter protocol. DNA concentration was determined using a Nanotrop and doing five replicate measurements. The mean value was used for further calculations. The number of DNA copies was calculated as follows:

$$\text{number of copies} = \frac{\text{DNA quantity}\left(\frac{g}{\mu l}\right)}{\text{fragment length} * 660 \text{ g/mol}} * 6{,}022 * 10^{\wedge}23$$

where fragment length is 8214658 bp (size of PsJN genome). For absolute quantification of DNA in seed samples, a calibration curve was generated from the real-time qPCR results of 3 respective replicates of a 10-fold serial dilution of the purified chromosomal DNA of PsJN. Unknown starting quantity of DNA copy numbers in the samples were calculated based on a standard curve. All data analysis was performed using the software Bio-Rad CFX Manager 3.0. Results were considered as positive when the starting quantity estimated was at least 10 copies. Only seeds for which two out of three replicates in qPCR gave a positive signal were considered to be colonized by strain PsJN.

Experiment Results

In general, PsJN was found in seeds of heads of summer wheat and barley (Table 35, Table 36, Table 37, and Table 38). Single heads were not evenly colonized by strain PsJN and the number of colonized seeds varied strongly from head to head.

TABLE 35 qPCR results of summer wheat (Trappe).
Numbers indicate seeds positive in PsJN specific qPCR of number of seeds tested. Base middle and top refer to seed positions for each of 8 samples (PsJN-endoseed).

| Head | T-PsJN (top) | T-PsJN (middle) | T-PsJN (bottom) |
|---|---|---|---|
| 1 | 0/2 | 0/2 | 2/2 |
| 2 | 1/2 | 1/2 | 2/2 |
| 3 | 2/2 | 1/2 | 1/2 |
| 4 | 2/2 | 0/2 | 1/2 |
| 5 | 0/2 | 0/2 | 0/2 |
| 6 | 0/2 | 0/2 | 0/2 |
| 7 | 0/2 | 1/2 | 0/2 |
| 8 | 0/2 | 0/2 | 0/2 |

TABLE 36 qPCR results of summer wheat (Kronjet).
Numbers indicate seeds positive in PsJN specific qPCR of total number of seeds tested. Base middle and top refer to seed positions for each of 8 samples (PsJN-endoseed).

| Head | K-PsJN (top) | K-PsJN (middle) | K-PsJN (bottom) |
|---|---|---|---|
| 1 | 0/2 | 0/2 | 0/2 |
| 2 | 0/2 | 0/2 | 0/2 |
| 3 | 0/2 | 0/2 | 0/2 |
| 4 | 0/2 | 0/2 | 1/2 |
| 5 | 1/2 | 0/2 | 0/2 |
| 6 | 2/2 | 1/2 | 0/2 |
| 7 | 0/2 | 0/2 | 0/2 |
| 8 | 0/2 | 0/2 | 1/2 |

TABLE 37 qPCR results of barley (Calcule).
Numbers indicate seeds positive in PsJN specific qPCR of total number of seeds tested. Base middle and top refer to seed positions for each of 8 samples (PsJN-endoseed).

| Head | C-PsJN (top) | C-PsJN (middle) | C-PsJN (bottom) |
|---|---|---|---|
| 1 | 1/2 | 0/2 | 1/2 |
| 2 | 1/2 | 1/2 | 1/2 |
| 3 | 2/2 | 1/2 | 2/2 |
| 4 | 0/2 | 1/2 | 1/2 |
| 5 | 0/2 | 0/2 | 0/2 |
| 6 | 0/2 | 0/2 | 0/2 |
| 7 | 0/2 | 0/2 | 0/2 |
| 8 | 0/2 | 0/2 | 0/2 |

TABLE 38 qPCR results of barley (Eunova).
Numbers indicate seeds positive in PsJN specific qPCR of total number of seeds tested. Base middle and top refer to seed positions for each of 8 samples (PsJN-endoseed).

| Head | E-PsJN (top) | E-PsJN (middle) | E-PsJN (bottom) |
|---|---|---|---|
| 1 | 1/2 | 2/2 | 1/2 |
| 2 | 1/2 | 1/2 | 1/2 |
| 3 | 2/2 | 2/2 | 0/2 |
| 4 | 1/2 | 2/2 | 0/2 |
| 5 | 1/2 | 1/2 | 1/2 |
| 6 | 0/2 | 0/2 | 1/2 |
| 7 | 1/2 | 0/2 | 0/2 |
| 8 | 1/2 | 1/2 | 0/2 |

Conclusions

Seeds of single heads were not evenly colonized by *B. phytofirmans* PsJN that had been applied by spraying flowers of parent plants.

Example 23

Drought Stress Assay with Seeds of *Hordeum vulgare*

The goal of this drought stress assay was to find out if there is a difference in the resistance to drought stress between endoseeds and untreated seeds of barley (*Hordeum vulgare* 'Eunova' and 'Calcule') inoculated with *Burkholderia phytofirmans* (PsJN), *Flavobacterium* sp. (TC38), *Paenibacillus tundrae* (S10), a mixture of *Paenibacillus tundrae* and *Burkholderia phytofirmans* (S10+PsJN) or *Aneuriniba-* cillus sp. Differences in germination were also rated. Use of a drought assay as a way to determine the presence of an endophyte in a plant bioreactor may be useful.

Experiment Description

Germination Assay:

Tested treatments are PsJN-EndoSeeds, TC38-EndoSeeds, S10-EndoSeeds, S10+PsJN-EndoSeeds, *Aneurinibacillus*-EndoSeeds and two negative controls (F1 and F2 generation). Treatments were tested in 20 replicates each. EndoSeeds and negative control F2 were produced on the field during the season 2014. Seeds were sown into unpunched seedtrays (28×24×6 cm). Right after sowing irrigation by hand took place.

Regular rating of the germination state (Table 39) and germination rate took place from day 1 until day 14, except germination rate, which only got rated until day 7 because as germination was finished by then.

To generate a drought stress, plants did not get irrigated any more from day 12 onwards.

Trays needed about 2 days for drying out. First symptoms could be seen on day 15 (3 days after irrigation was stopped). Drought was rated according to Table 40.

Figure 44:
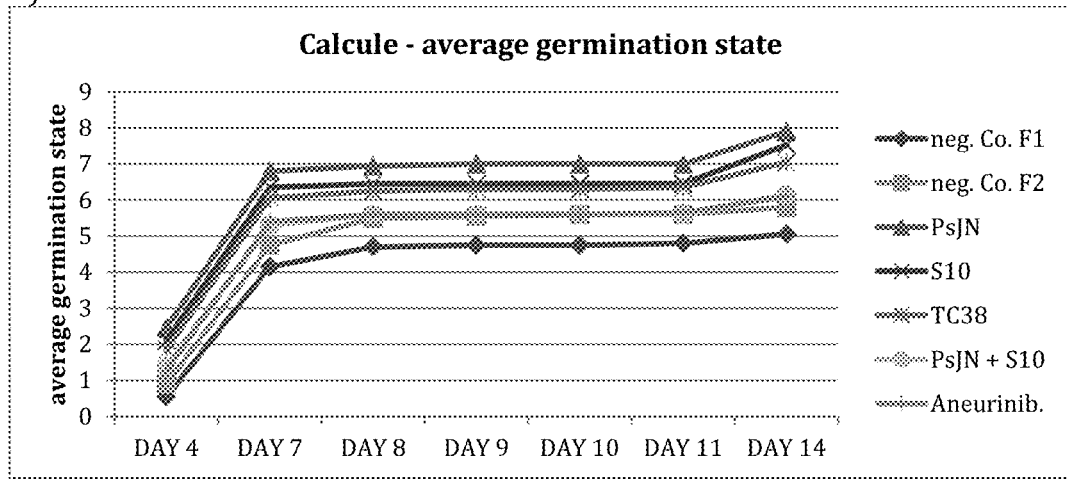
FIG. 44 shows the germination state (A), germination rate (B), and average drought stress (C) in a barley drought assay using the Calcule va.
Figure 44:
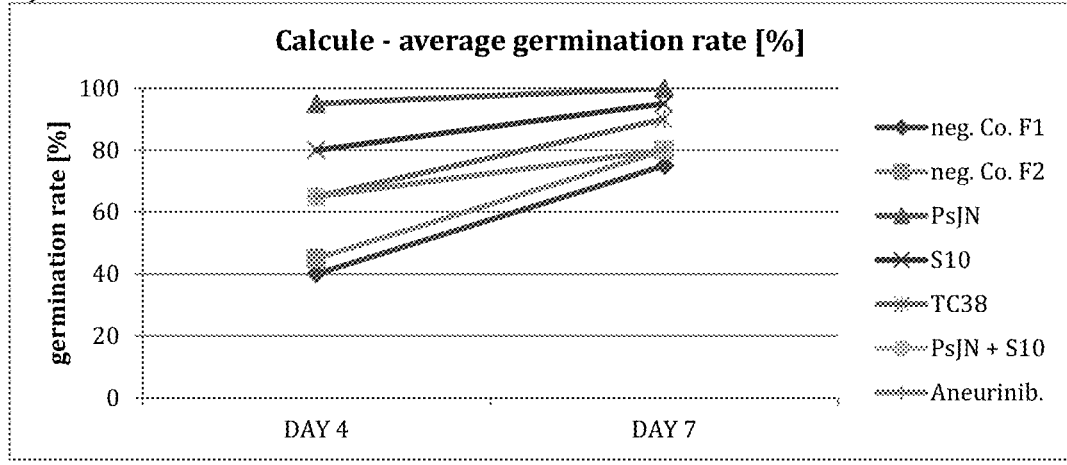
Figure 44:
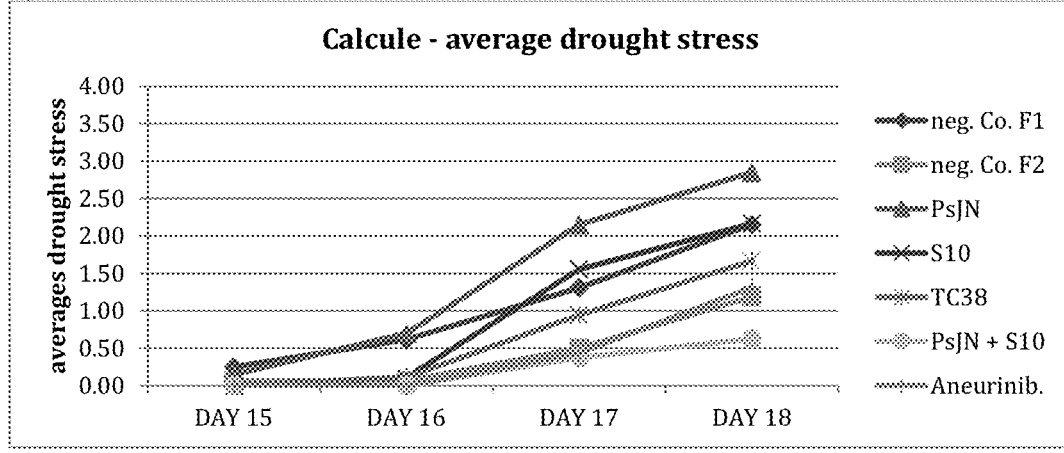
Figure 45:
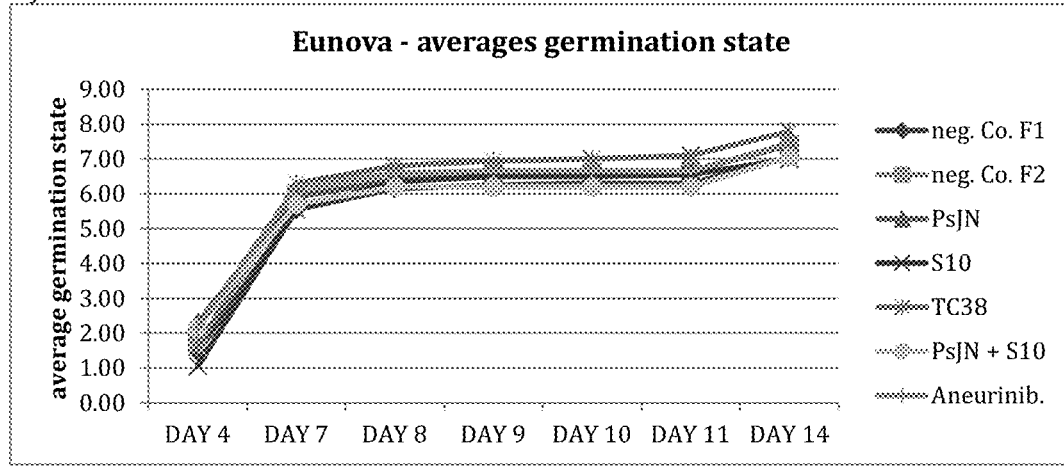
FIG. 45 shows the germination state (A), germination rate (B), and average drought stress (C) in a barley drought assay using the Eunova va.
Figure 45:
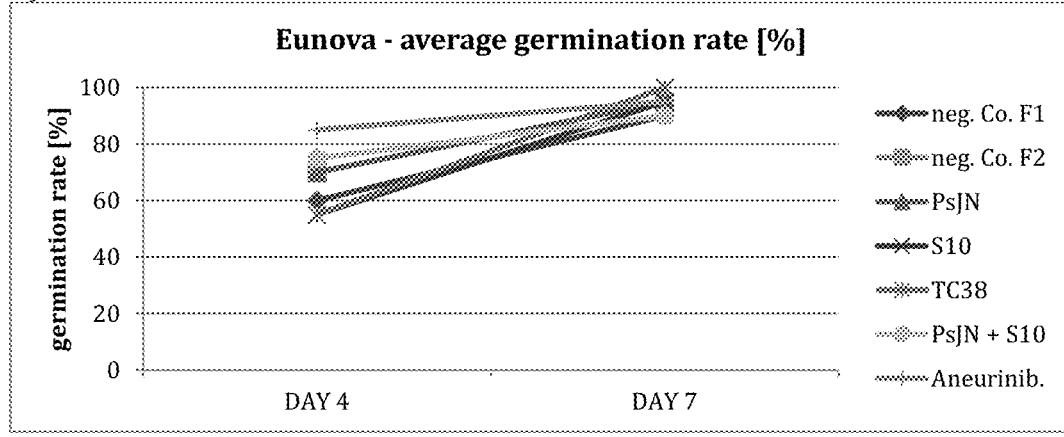
Figure 45:
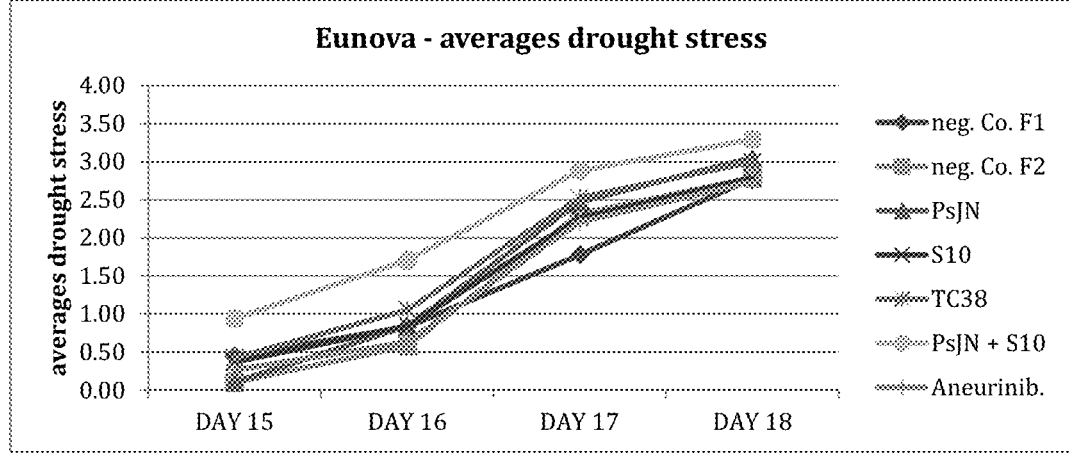

Data of the germination state, germination rate, and drought stress are seen in FIG. 44 (Calcule) and FIG. 45 (Eunova).

TABLE 39 rating system for germination state

| | Type of germination |
|---|---|
| 0 | No germination |
| 1 | Germination |
| 2 | Germinated, cotyledon-closed |
| 3 | Erect, cotyldedon closed |
| 4 | cotyledon visible but closed |

TABLE 39-continued rating system for germination state

| | Type of germination |
|---|---|
| 5 | cotyledon visible but not fully opened |
| 6 | cotyledon fully opened |
| 7 | cotyledon completely opened + new shoot |
| 8 | 2. shoot |
| 9 | Additional shoot |

TABLE 40 rating system for type of drought stress

| | Type of drought stress |
|---|---|
| 0 | no wilting |
| 1 | plant is droopy, leaves start curling |
| 2 | cotyledon starts wilting |
| 3 | cotyledon dried up, real leaves begin to wilt till are dried up |
| 4 | All parts of the plant are dried up |

Results

In this experiment the effect of bacteria of different phylogeny and origin introduced into seeds of barley on seedling response to drought stress. The results are summarized in FIGS. 44 and 45. Barley seeds responded to the incorporated bacteria. Effects were found for germination rate, germination time and silencing of drought stress symptoms. Three strains and combinations (PsJN, TC38, S10) increased germination rate and germination time of barley cv. Calcule (FIGS. 44 and 45). Seedlings emerging from PsJN+S10- or AB-endoseeds of barley cv. Calcule showed weaker symptoms of drought stress than control seeds.

Conclusions

Use of a drought assay as a way to determine the presence of an endophyte in a plant bioreactor may be useful.

TABLE A

BACTERIAL GENERA

*Acidobacterium, Geothrix, Holophaga, Acidimicrobium, Actinobaculum, Actinomyces, Arcanobacterium, Mobiluncus, Trueperella, Varibaculum Corynebacterium, Gordoniaceae, Mycobacterium, Nocardia, Rhodococcus, Smaragdicoccus, Micropolyspora, Frankia, Actinotelluria, Blastococcus, Geodermatophilus, Modestobacter, Angustibacter, Kineococcus, Kineosporia, Pseudokineococcus, Quadrisphaera, Glycomyces, Haloglycomyces, Stackebrandtia, Beutenbergia, Miniimonas, Salana, Serinibacter, Bogoriella, Georgenia Brevibacterium, Actinotalea, Cellulomonas, Oerskovia, Paraoerskovia, Tropheryma, Brachybacterium. Dermabacter, Devriesea, Helcobacillus, Nostocoida type II, Arsenicicoccus, Fodinibacter, Humibacillus, Humihabitans, Intrasporangium, Janibacter, Knoellia, Kribbia, Lapillicoccus, Marihabitans, Ornithinibacter, Ornithinicoccus, Ornithinimicrobium, Oryzihumus, Phycicoccus, Serinicoccus, Terrabacter, Terracoccus, Tetrasphaera, Candidatus Aquiluna, Candidatus Flaviluna, Candidatus Limnoluna, Candidatus Planktoluna, Candidatus Rhodoluna, Agreia, Agrococcus, Agromyces, Amnibacterium, Chryseoglobus, Clavibacter, Crocebacterium, Cryobacterium, Cryocola, Curtobacterium, Frigoribacterium, Frondihabitans, Glaciibacter, Gulosibacter, Herbiconiux, Humibacter, Klugiella, Labedella, Leifsonia, Leucobacter, Marisediminicola, Microbacterium, Microcella, Microterricola, Mycetocola, Okibacterium, Phycicola, Plantibacter, Pseudoclavibacter, Rathayibacter, Rhodoglobus, Salinibacterium, Schumannella, Subtercola, Yonghaparkia, Zimmermannell, Acaricomes, Arthrobacter, Auritidibacter, Citricoccus, Kocuria, Micrococcus, Nesterenkonia, Renibacterium, Rothia, Sinomonas, Tersicoccus, Yaniella, Zhihengliuella, Cellulosimicrobium, Isoptericola, Myceligenerans, Promicromonospora, Xylanibacterium, Xylanimicrobium, Xylanimonas, Rarobacter, Sanguibacte, Actinaurispora, Actinocatenispora, Actinoplanes, Allocatelliglobosispora, Asanoa, Catellatospora, Catelliglobosispora, Catenuloplanes, Couchioplanes, Dactylosporangium, Hamadaea, Jishengella, Krasilnikovia, Longispora, Luedemannella, Micromonospora, Phytohabitans, Phytomonospora, Pilimelia, Planosporangium, Plantactinospora, Polymorphospora, Pseudosporangium, Rugosimonospora, Salinispora, Spirilliplanes, Solwaraspora, Verrucosispora, Virgisporangium, Wangella, Nocardia, Kribella, Propionibacterium, Actinosynnemata, Actinoalloteichus, Actinokineospora, Actinomycetospora, Actinophytocola, Actinosynnema, Alloactinosynnema, Allokutzneria, Amycolatopsis, Crossiella, Goodfellowiella, Haloechinothrix, Kibdelosporangium, Kutzneria, Lechevalieria, Lentzea, Prauseria, Prauserella, Pseudonocardia, Saccharomonospora, Saccharopolyspora, Saccharothrix, Saccharothrixopsis, Sciscionella, Streptoalloteichus, Thermobispora, Thermocrispum, Umezawaea, Yuhushiella, Kitasatospora, Streptomyces, Streptoverticillium, Nocardiopsis, Streptosporangia, Thermomonospora, Actinomadura,*

TABLE A-continued

BACTERIAL GENERA

*Actinocorallia, Spirillospora, Aeriscardovia, Alloscardovia, Bifidobacterium, Gardnerella, Metascardovia, Parascardovia, Scardovia. Atopobium, Collinsella, Coriobacterium, Cryptobacterium, Denitrobacterium, Eggerthella, Slackia, Rubrobacter, Sphaerobacter, Aquifex, Hydrogenivirga, Hydrogenobacter, Hydrogenobaculum, Thermocrinis, Hydrogenothermus, Persephonella, Sulfurihydrogenibium, Venenivibrio, Bacteroides, Acetofilamentum, Acetomicrobium, Acetothermus, Anaerorhabdus, Megamonas, Rikenella, Marinilabilia, Porphyromonas, Dysgonomonas, Prevotella, Actibacter, Aequorivita, Algibacter, Aquimarina, Arenibacter, Bergeyella, Bizionia, Capnocytophaga, Cellulophaga, Chryseobacterium, Cloacibacterium, Coenonia, Costertonia, Croceibacter, Dokdonia, Donghaeana, Elizabethkingia, Empedobacter, Epilithonimonas, Flagellimonas, Flaviramulus, Flavobacterium, Formosa, Gaetbulibacter, Galbibacter, Gelidibacter, Gillisia, Gilvibacter, Gramella, Joostella, Kaistella, Kordia, Krokinobacter, Leeuwenhoekiellam, Lutibacter, Lutimonas, Maribacter, Mariniflexile, Marixanthomonas, Mesonia, Muricauda, Myroides, Nonlabens, Ornithobacterium, Pibocella, Polaribacter, Psychroflexus, Psychroserpens, Riemerella, Robiginitalea, Salegentibacter, Salinimicrobium, Sandarakinotalea, Sediminibacter, Sediminicola, Sejongia, Spongiimonas, Stenothermobacter, Subsaxibacter, Subsaximicrobium, Tamlana, Tenacibaculum, Ulvibacter, Vitellibacter, Wautersiella, Weeksella, Winogradskyella, Yeosuana, Zeaxanthinibacter, Zhouia, Zobellia, Zunongwangia, Myroides, Psychromonas, Blattabacterium, Rhodotherma, Sphingobacterium, Pedobacter, Mucilaginibacter, Saprospira, Haliscomenobacter, Lewinella, Flexibacter, Cyclobacterium, Cytophaga, Dyadobacter, Flectobacillus, Hymenobacter, Meniscus, Microscilla, Runella, Spirosoma, Sporocytophaga, Flammeovirga, Flexithrix, Persicobacter, Thermonema, Crenothrix, Chitinophaga, Rhodothermus, Toxothrix, Chlamydia, Chlamydophila, Parachlamydia, Protochlamydia, Neochlamydia, Rhabdochlamydia, Simkania, Fritschea, Waddlia, Chlorobium, Ancalochloris, Chloroherpeton, Clathrochloris, Pelodictyon, Prostheochloris, Herpetosiphon, Chloroflexus, Oscillochloris, Chloronema, Roseiflexus, Heliothrix, Herpetosiphon, Chrysiogenes, Microcystis, Anacystis, Chondrocystis, Eucapsis, Gloeocapsa, Merismopedia, Polycystis, Camptylonemopsis, Coleodesmiopsis, Coleodesmium, Fortiea, Hassallia, Microchaete, Ophiothrix, Petalonema, Rexia, Spirirestris, Streptostemon, Tolypothrix, Anabaena, Anabaenopsis, Aphanizomenon, Aulosira, Cylindrospermopsis, Cylindrospermum, Loefgrenia, Nodularia, Nostoc, Wollea, Amphithrix, Calothrix, Dichothrix, Diplotrichia, Gaillardotella, Gardnerula, Gloeotrichia, Gloiotrichia, Heteractis, Inomeria, Isactis, Mastigonema, Montanoa, Primorivularia, Rivularia, Rivulariopsis, Sacconema, Tildenia, Zonotrichites, Arthrosiphon, Arthrosiphon, Brasilonema, Desmonema, Diplocolon, Drilosiphon, Drilosiphon, Eoplectonema, Kyrtuthrix, Paraortonella, Scytonema, Scytonematopsis, Stigonemata, Deferribacter, Denitrovibrio, Flexistipes, Geovibrio, Deinococcus, Thermus, Meiothermus, Marinithermus, Oceanithermus, Vulcanithermus, Dictyoglomus, Fibrobacter, Alicyclobacillus, Pasteuria, Sulfobacillus, Alkalibacillus, Amphibacillus, Anoxybacillus, Bacillus, Caldalkalibacillus, Cerasibacillus, Exiguobacterium, Filobacillus, Geobacillus, Gracilibacillus, Halalkalibacillus, Halobacillus, Halolactibacillus, Jeotgalibacillus, Lentibacillus, Lysinibacillusm, Marinibacillus, Oceanobacillus, Ornithinibacillus, Paraliobacillus, Paucisalibacillus, Pelagibacillus, Piscibacillus, Pontibacillus, Saccharococcus, Salibacillus, Salimicrobium, Salinibacillus, Salirhabdus, Salsuginibacillus, Tenuibacillus, Terribacillus, Thalassobacillus, Ureibacillus, Virgibacillus, Vulcanibacillus, Caryophanon, Brochothrix, Listeria, Paenibacillus, Ammoniphilus, Aneurinibacillus, Brevibacillus, Oxalophagus, Thermicanus, Thermobacillus, Filibacter, Kurthia, Planomicrobium, Sporosarcina, Sinobaca, Sporolactobacillus, Tuberibacillus, Staphylococcus, Gemella, Jeotgalicoccus, Macrococcus, Salinicoccus, Nosocomiicoccus, Shimazuella, Thermoactinomyces, Turicibacter, Acidaminococcus, Acetonema, Allisonella Anaeroarcus Anaeroglobus, Anaeromusa, Anaerosinus, Anaerospora, Anaerovibrio, Centipeda, Dendrosporobacter, Desulfosporomusa, Dialister, Megamonas, Megasphaera, Rogosa, Mitsuokella, Negativicoccus, Pectinatus, Pelosinus, Propionispira, Propionispora, Psychrosinus, Quinella, Schwartzia, Selenomonas, Sporolituus, Sporomusa, Thermosinus, Veillonella, Zymophilus, Phascolarctobacterium, Succiniclasticum, Succinispira, Acetanaerobacterium, Acetivibrio, Acidaminobacter, Alkaliphilus, Anaerobacter, Anaerotruncus, Anoxynatronum, Bryantella, Butyricicoccus, Caldanaerocella, Caloramator, Caloranaerobacter, Caminicella, Candidatus Arthromitus, Clostridium, Coprobacillus, Dorea, Ethanologenbacterium, Faecalibacterium, Garciella, Guggenheimella, Hespellia, Linmingia, Natronincola, Oxobacter, Parasporobacterium, Sarcina, Soehngenia, Sporobacter, Subdoligranulum, Tepidibacter, Tepidimicrobium, Thermobrachium, Thermohalobacter, Tindallia, Acetobacterium, Alkalibaculum, Anaerofustis, Anaerovorax, Eubacterium, Mogibacterium, Pseudoramibacter, Candidatus Helioclostridium, Heliobacterium, Heliobacillus, Heliophilum, Heliorestis, Lachnospira, Anaerospora, Carboxydothermus, Cryptanaerobacter, Dehalobacter, Desulfitobacterium, Desulfonispora, Desulfosporosinus, Desulfotomaculum, Pelotomaculum, Peptococcus, Syntrophobotulus, Thermincola, Thermoterrabacterium, Filifactor, Finegoldia, Fusibacter, Helcococcus, Peptostreptococcus, Tissierella, Syntrophomonad, Halanaerobia, Halobacteroidaceae, Thermoanaerobacteria, Coprothermobacter Thermodesulfobium, Hepatoplasma (Candidatus), Mycoplasma, Ureaplasma, Entomoplasma, Mesoplasma, Spiroplasma, Anaeroplasma, Asteroleplasma, Erysipelothrix, Holdemania, Acholeplasma, Phytoplasma (Candidatus), Fusobacterium, Gemmatimonas, Nitrospira, Gemmata, Isosphaera, Pirellula, Planctomyces, Brocadia (candidatus), Kuenenia (candidatus), Scalindua (candidatus), Anammoxoglobus (candidatus), Jettenia (candidatus), Asticcacaulis, Brevundimonas, Caulobacter, Phenylobacterium, Kordiimonas, Parvularcula, Aurantimonas, Fulvimarina, Bartonella, Beijerinckia, Chelatococcus, Derxia, Methylocella, Afipia, Agromonas, Blastobacter, Bosea, Bradyrhizobium, Nitrobacter, Oligotropha, Photorhizobium, Rhodoblastus, Rhodopseudomonas, Brucella, Mycoplana, Ochrobactrum, Ancalomicrobium, Ancylobacter, Angulomicrobium, Aquabacter, Azorhizobium, Blastochloris, Devosia, Dichotomicrobium, Filomicrobium, Gemmiger, Hyphomicrobium, Labrys, Methylorhabdus, Pedomicrobium, Prosthecomicrobium, Rhodomicrobium, Rhodoplanes, Seliberia, Starkeya, Xanthobacter, Methylobacterium, Microvirga, Protomonas, Roseomonas, Methylocystis, Methylosinus, Methylopila, Aminobacter, Aquamicrobium, Defluvibacter, Hoeflea, Mesorhizobium, Nitratireductor, Parvibaculum, Phyllobacterium, Pseudaminobacter, Agrobacterium, Rhizobium, Sinorhizobium, Liberibacter (candidatus), Rhodobium, Ahrensia, Albidovulum, Amaricoccus, Antarctobacter,*

TABLE A-continued

BACTERIAL GENERA

*Catellibacterium, Citreicella, Dinoroseobacter, Haematobacter, Jannaschia, Ketogulonicigenium, Leisingera, Loktanella, Maribius, Marinosulfonomonas, Marinovum, Maritimibacter, Methylarcula, Nereida, Oceanibulbus, Oceanicola, Octadecabacter, Palleronia, Pannonibacter, Paracoccus, Phaeobacter, Pseudorhodobacter, Pseudovibrio, Rhodobaca, Rhodobacter, Rhodothalassium, Rhodovulum, Roseibacterium, Roseibium, Roseicyclus, Roseinatronobacter, Roseisalinus, Roseivivax, Roseobacter, Roseovarius, Rubrimonas, Ruegeria, Sagittula, Salipiger, Silicibacter, Staleya, Stappia, Sulfitobacter, Tetracoccus, Thalassobacter, Thalassobius, Thioclava, Yangia, Azospirillum, Dechlorospirillum, Defluvicoccus, Inquilinus, Magnetospirillum, Phaeospirillum, Rhodocista, Rhodospira, Rhodospirillum, Rhodovibrio, Roseospira, Skermanella, Thalassospira, Tistrella, Acetobacter, Acidicaldus, Acidiphilium, Acidisphaera, Acidocella, Acidomonas, Asaia, Belnapia, Craurococcus, Gluconacetobacter, Gluconobacter, Kozakia, Leahibacter, Muricoccus, Neoasaia, Oleomonas, Paracraurococcus, Rhodopila, Roseococcus, Rubritepida, Saccharibacter, Stella, Swaminathania, Teichococcus, Zavarzinia, Rickettsia, Orientia, Wolbachia, Aegyptianella, Anaplasma, Cowdria, Ehrlichia, Neorickettsia, Caedibacter, Holospora, Lyticum, Odyssella, Symbiotes, Tectibacter, Blastomonas, Citromicrobium, Erythrobacter, Erythromicrobium, Kaistobacter, Lutibacterium, Novosphingobium, Porphyrobacter, Sandaracinobacter, Sphingobium, Sphingomonas, Sphingopyxis, Zymomonas, Achromobacter, Alcaligenes, Bordetella, Pelistega, Sutterella, Taylorella, Burkholderia, Chitinimonas, Cupriavidus, Lautropia, Limnobacter, Pandoraea, Paucimonas, Polynucleobacter, Ralstonia, Thermothrix, Acidovorax, Aquabacterium, Brachymonas, Comamonas, Curvibacter, Delftia, Hydrogenophaga, Ideonella, Leptothrix, Limnohabitans, Pelomonas, Polaromonas, Rhodoferax, Roseateles, Sphaerotilus, Tepidimonas, Thiomonas, Variovorax, Collimonas, Duganella, Herbaspirillum, Herminiimonas, Janthinospirillum, Massilia, Naxibacter, Oxalobacter, Oxalicibacterium, Telluria, Hydrogenophilus, Tepidiphilus, Methylophilus, Methylobacillus, Methylovorax, Alysiella, Aquaspirillum, Catenococcus, Chromobacterium, Eikenella, Formivibrio, Iodobacter, Kingella, Microvirgula, Neisseria, Prolinoborus, Simonsiella, Vitreoscilla, Vogesella, Nitrosomonas, Nitrosospira, Gallionella, Spirillum, Azoarcus, Azonexus, Azospira, Azovibrio, Dechloromonas, Ferribacterium, Petrobacter, Propionivibrio, Rhodocyclus, Sterolibacterium, Thauera, Zoogloea, Acidithiobacillus, Thermithiobacillus, Aeromonas, Tolumonas, Anerobiospirillum, Ruminobacter, Succinimonas, Succinivibrio, Aestuariibacter, Agarivorans, Aliagarivorans, Alishewanella, Alteromonas, Bowmanella, Catenovulum, Glaciecola, Haliea, Marinimicrobium, Marinobacter, Marinobacterium, Microbulbifer, Saccharophagus, Salinimonas, Celerinatantimonads, Colwellia, Thalassomonas, Ferrimonas, Idiomarina, Moritella, Pseudoalteromonas, Algicola, Psychromonas, Shewanella, Cardiobacterium, Dichelobacter, Suttonella, Allochromatium, Amoebobacter, Chromatium, Halochromatium, Isochromatium, Lamprobacter, Lamprocystis, Marichromatium, Nitrosococcus, Pfennigia, Rhabdochromatium, Rheinheimera, Thermochromatium, Thioalkalicoccus, Thiobaca, Thiocapsa, Thiococcus, Thiocystis, Thiodictyon, Thioflavicoccus, Thiohalocapsa, Thiolamprovum, Thiopedia, Thiophaeococcus, Thiorhodococcus, Thiorhodovibrio, Thiospirillum, Alkalilimnicola, Alkalispirillum, Aquisalimonas, Arhodomonas, Ectothiorhodosinus, Ectothiorhodospira, Halorhodospira, Natronocella, Nitrococcus, Thioalkalispira, Thioalkalivibrio, Thiohalospira, Thiorhodospira, Granulosicoccus, Halothiobacillus, Thioalkalispira, Alishewanella, Alterococcus, Aquamonas, Aranicola, Arsenophonus, Azotivirga, Blochmannia, Brenneria, Buchnera, Budvicia, Buttiauxella, Cedecea, Citrobacter, Cronobacter, Dickeya, Edwardsiella, Enterobacter, Erwinia, Escherichia, Ewingella, Grimontella, Hafnia, Hamiltonella, Klebsiella, Kluyvera, Leclercia, Leminorella, Moellerella, Morganella, Obesumbacterium, Pantoea, Pectobacterium, Candidatus Phlomobacter, Photorhabdus, Plesiomonas, Pragia, Proteus, Providencia, Rahnella, Regiella, Raoultella, Salmonella, Samsonia, Serratia, Shigella, Sodalis, Tatumella, Trabulsiella, Wigglesworthia, XenorhabdusYersinia, Yokenella, Coxiella, Legionells, Crenothrix, Chitinophaga, Rhodothermus, Toxothrix, Methylomonas, Methylobacter, Methylococcus, Methylomicrobium, Methylosphaera, Methylocaldum, Alcanivorax, Uruburuia, Hahella, Carnimonas, Chromohalobacter, Cobetia, Halomonas, Portiera, Zymobacter, Litocolum, Balneatrix, Fundibacter, Marinomonas, Marinospirillum, Neptunomonas, Oceanospirillum, Oleiphilum, Saccharospirillum, Actinobacillus, Aggregatibacter, Haemophilus, Lonepinella, Pasteurella, Mannheimia, Phocoenobacter, Acinetobacter, Alkanindiges, Branhamella, Enhydrobacter, Moraxella, Paraperlucidibaca, Perlucidibaca, Psychrobacter, Azomonas, Azomonotrichon, Azorhizophilus, Azotobacter, Cellvibrio, Mesophilobacter, Pseudomonas, Rhizobacter, Rugamonas, Serpens, Salinisphaer, Francisella, Cycloclasticus, Hydrogenovibrio, Methylophaga, Piscirickettsia, Thioalkalimicrobium, Thiomicrospira, Achromatium, Beggiatoa, Leucothrix, Macromonas, Thiobacterium, Thiomargarita, Thioploca, Thiospira, Thiothrix, Aliivibrio, Allomonas, Beneckea, Enhydrobacter, Listonella, Lucibacterium, Photobacterium, Salinivibrio, Vibrio, Sinobactera, Frateuria, Luteimonas, Lysobacter, Nevskia, Pseudoxanthomonas, Rhodanobacter, Stenotrophomonas, Xanthomonas, Xylella, Algicola, Colwellia, Thalassomonas, Shewanella, Bdellovibrio, Micavibrio, Vampirovibrio, Desulfobacteraceae, Desulfobulbaceae, Desulfoarculaceae, Desulfovibrio, Bilophila, Lawsonia, Desulfohalobium, Desulfomonas, Desulfonatronovibrio, Desulfomicrobium, Desulfonatronum, Desulfurella, Hippe, Desulfuromonas, Desulfuromusa, Malonomonas, Pelobacter, Geoalkalibacter, Geobacter, Myxococcus, Stigmatella, Sorangium, Desulfacinum, Desulforhabdus, Syntrophobacter, Syntrophothermus, Thermaerobacter, Thermodesulforhabdus, Syntrophus, Smithella, Campylobacter, Arcobacter, Sulfurospirillum, Thiovulum, Helicobacter, Wolinella, Caminibacter, Lebetimonas, Nautilia, Nitratifractor, Nitratiruptor, Thioreductor, Borrelia, Brevinema, Cristispira, Spirochaeta, Spironema, Treponema, Brachyspira, Leptospira, Leptonema, Thermodesulfobacterium, Thermatoga, Verrucomicrobium, Prosthecobacter,* and *Akkermansia.*

TABLE B

| BACTERIAL ENDOPHYTES | | |
|---|---|---|
| *Acetobacter* sp.[1] | *Enterobacter cloacae* subsp. *cloacae*[2] | *Photobacterium* sp.[1] |
| *Achromobacter* sp.[1] | *Enterobacter dissolvens*[3] | *Phyllobacterium* sp.[1] |
| *Achromobacter spanius*[2] | *Enterobacter hormaechei*[7] | *Phytoplasma vitis*[17] |
| *Achromobacter xylosoxidans*[3] | *Enterobacter intermedius*[16] | *Planomicrobium glaciei*[3] |
| *Acidithiobacillus albertensis*[3] | *Enterobacter ludwigii*[11] | Plantibacterflavus[2] |
| *Acidovorax facilis*[3] | *Enterobacter nimipressuralis*[3] | Plantibactersp.[6] |
| *Acidovorax* sp.[4] | *Enterobacter oryzae*[3] | *Polaribacter* sp. 3-17, gb\|ABS01329.1\|[5] |
| *Acidovorax* sp.[1] | *Enterobacter sakazakii*[1] | *Ponticoccus gilvus*[6] |
| *Acidovorax temperans*[3] | *Enterobacter sakazakii* ATCC BAA-894, ref\|YP_001436701.1\|[5] | *Propionibacterium acnes*[3] |
| *Acidovoraz temperans*[3] | *Enterobacter* sp.[3] | *Propioniciclava tarda*[3] |
| *Acinetobacter baumannii*[1] | *Enterobacter* sp.[16] | *Providencia rustigianii*[3] |
| *Acinetobacter baumannii*[3] | *Enterobacter* sp. 638 (ABP60470)[5] | *Providencia* sp.[1] |
| *Acinetobacter baumannii* ATCC 17978 (ABO13540)[5] | *Enterobacter* sp. 638 (ABP60470)[5] | *Pseudoalteromonas* sp.[5] |
| *Acinetobacter baumannii* ATCC 17978 (ABO13540)[5] | *Enterococcus gallinarum*[7] | *Pseudoalteromonas* sp. AS-11, dbj\|BAB61726.1\|[5] |
| *Acinetobacter beijerinckii*[2] | *Erwinia aphidicola*[3] | *Pseudomonas £uorescens*[14] |
| *Acinetobacter beijerinckii*[3] | *Erwinia chrysanthemi*[5] | *Pseudomonas aeruginosa* PA7 (ABR85743)[5] |
| *Acinetobacter calcoaceticus*[3] | *Erwinia cypripedi*[3] | *Pseudomonas aeruginosa* PA7 (ABR85743)[5] |
| *Acinetobacter johnsonii*[3] | *Erwinia persicina*[17] | *Pseudomonas aureofaciens*[1] |
| *Acinetobacter junii*[3] | *Erwinia* sp.[1] | *Pseudomonas chloroaphis*[1] |
| *Acinetobacter kyonggiensis*[3] | *Erwinia*-like sp.[1] | *Pseudomonas cichorii*[1] |
| *Acinetobacter lwoffii*[3] | *Escherichia coli*[2] | *Pseudomonas citronellolis*[1] |
| *Acinetobacter radioresistens*[3] | *Escherichia coli*[3] | *Pseudomonas corrugata*[1] |
| *Acinetobacter schindleri*[3] | *Escherichia coli*[1] | *Pseudomonas fluorescens*[1] |
| *Acinetobacter* sp.[3] | *Escherichia hermannii*[3] | *Pseudomonas fluorescens* Pf0-1 (ABA76623)[5] |
| *Acinetobacter* sp.[1] | *Escherichia* sp.[1] | *Pseudomonas fluorescens* Pf0-1 (ABA76623)[5] |
| *Actinobacter* sp.[6] | *Ewingella americana*[17] | *Pseudomonas fragi*[3] |
| *Actinomyces* sp.[1] | *Finegoldia magna*[3] | *Pseudomonas fulva*[1] |
| *Aerobacter cloaceae*[1] | *Flavisolibacter ginsengiterrae*[3] | *Pseudomonas hibiscicola*[3] |
| *Aerococcus urinaeequi*[3] | Flavobacteriales bacterium HTCC2170, ref\|ZP_01105756.1\|[5] | *Pseudomonas lanceolata*[3] |
| *Aeromonas hydrophila*[5] | *Flavobacterium aquatile*[3] | *Pseudomonas mendocina*[5] |
| *Arthrobacter ramosus*[7] | *Flavobacterium degerlachei*[3] | *Pseudomonas moraviensis*[1] |
| *Arthrobacter* sp.[11] | *Flavobacterium johnsoniae*[2] | *Pseudomonas oleovarans*[11] |
| *Arthrobacter ureafaciens*[1] | *Flavobacterium johnsoniae*[3] | *Pseudomonas oryzihabitans*[2] |
| *Atopobium rimae* ATCC 49626, ref\|ZP_03568303.1\|[5] | *Flavobacterium mizutaii*[3] | *Pseudomonas oryzihabitans*[3] |
| *Azoarcus* sp. strain BH72[8] | *Flavobacterium* sp.[1] | *Pseudomonas oryzihabitans*[7] |
| *Azoarcus* spp.[9] | *Frigoribacterium faeni*[2] | *Pseudomonas plecoglossicida*[3] |
| *Azobacter chroococcum*[1] | *Frigoribacterium* sp.[12] | *Pseudomonas poae*[3] |
| *Azorhizobium caulinodans*[5] | *Gemmata obscuriglobus* UQM 2246, ref\|ZP_02731927.1\|[5] | *Pseudomonas protegens*[2] |
| *Azospirillum brasilense*[1] | *Geobacter* sp. FRC-32, ref\|YP_002535550.1\|[5] | *Pseudomonas putida*[1] |
| *Azospirillum zea*[7] | *Georgfuchsia toluolica*[3] | *Pseudomonas putida*[2] |
| *Azotobacter chroococcum*[1] | *Gluconacetobacter diazothrophicus*[1] | *Pseudomonas putida* F1 (ABQ77146)[5] |
| *Bacillus alclophialus*[1] | *Hafnia alvei*[7] | *Pseudomonas putida* F1 (ABQ77146)[5] |
| *Bacillus anthracis*[3] | *Halomonas daqingensis*[3] | *Pseudomonas putida* W619 (ACA72735)[5] |
| *Bacillus aryabhattai*[3] | *Herbaspirillum rubrisubalbicans*[11] | *Pseudomonas rhodesiae*[12] |
| *Bacillus asahai*[7] | *Herbaspirillum rubrisubalvicans*[2] | *Pseudomonas saccharophila*[1] |
| *Bacillus brevis*[1] | *Herbaspirillum seropedicae*[5] | *Pseudomonas* sp.[1] |
| *Bacillus cereus*[5] | *Herbaspirillum* sp.[1] | *Pseudomonas* sp.[3] |
| *Bacillus cereus*[10] | *Herpetosiphon aurantiacus* ATCC 23779 (ABX02684)[5] | *Pseudomonas stamineaj*[1] |
| *Bacillus cereus* 03BB108, ref\|ZP_03110815.1\|[5] | *Herpetosiphon aurantiacus* ATCC 23779 (ABX02684)[5] | *Pseudomonas stutzeri*[3] |
| *Bacillus circulans*[7] | *Herpetosiphon aurantiacus* ATCC 23779, ref\|YP_001545781.1\|[5] | *Pseudomonas stutzeri*[1] |
| *Bacillus endophyticus*[1] | *Hydrocarboniphaga effusa*[3] | *Pseudomonas syringae*[1] |
| *Bacillus licheniformis*[11] | *Hydrogenophaga pseudoflava*[1] | *Pseudomonas syringae* pv. phaseolicola 1448A (AAZ34722)[5] |

TABLE B-continued

| BACTERIAL ENDOPHYTES | | |
|---|---|---|
| Bacillus megaterium[1] | Hydrogenophaga sp.[1] | Pseudomonas tolaasii[1] |
| Bacillus mojavensis[1] | Janthinobacterium sp. IC161[11] | Pseudonocardia aurantiaca[3] |
| Bacillus novalisa[1] | Kingella denitrificans[1] | Pseudoxanthomonas kaohsiungensis[3] |
| Bacillus pasteurii[1] | Kingella kingae[1] | Psychrobacter immobilis[1] |
| Bacillus polymyxa[1] | Klebsiella oxytoca[1] | Psychrobacter pulmonis[3] |
| Bacillus psychrosaccharolyticus[2] | Klebsiella pneumoniae[1] | Psychrobacter sp.[1] |
| Bacillus pumilus[1] | Klebsiella pneumoniae[7] | Psychrobacter urativorans[3] |
| Bacillus pumilus[4] | Klebsiella pneumoniae[3] | Psychroflexus torquis ATCC 700755, ref|ZP_01254843.1|[5] |
| Bacillus pumilus SAFR-032, ref|YP_001486461.1|[5] | Klebsiella pneumoniae 342 (ACI07402)[5] | Rahnella aquatilis[18] |
| Bacillus simplex[11] | Klebsiella pneumoniae 342 (ACI07402)[5] | Ralstonia japonicum[1] |
| Bacillus sp.[1] | Klebsiella sp.[1] | Rheinheimera chironomi[3] |
| Bacillus sp. SG-1 (EDL63514)[5] | Klebsiella variicola[3] | Rheinheimera soli[3] |
| Bacillus sp. SG-1 (EDL63514)[5] | Kluyvera sp.[1] | Rhizobium etli[11] |
| Bacillus sphaericus[1] | Kocuria rosea[3] | Rhizobium leguminosarum bv. trifolii WSM1325, ref|ZP_02293701.1|[5] |
| Bacillus stratosphericus[3] | Kordia algicida OT-1, ref|ZP_02160368.1|[5] | Rhizobium leguminosarum bv. Viciae, gb|AAO21112.1|[5] |
| Bacillus subtilis[1] | Kytococcus sedentarius[11] | Rhizobium massiliae[3] |
| Bacillus subtilis[4] | Lactobacillus iners[3] | Rhizobium mesosinicum[11] |
| Bdellovibrio bacteriovorus[3] | Lactobacillus sp.[1] | Rhizobium pisi[3] |
| Beijerinckia indica subsp. indica ATCC 9039 (ACB96131)[5] | Leclercia adecarboxylata[3] | Rhizobium radiobacter[2] |
| Beijerinckia indica subsp. indica ATCC 9039 (ACB96131)[5] | Lentzea flaviverrucosa[3] | Rhodobacteraceae bacterium KLH11, gb|EEE38433.1|[5] |
| Bifidobacterium adolescentis[5] | Leptospirillum sp.[5] | Rhodobacterales bacterium HTCC2654, ref|YP_002689546.1|[5] |
| Bifidobacterium adolescentis ATCC 15703, ref|YP_909356.1|[5] | Leptospirillum sp. Group II '5-way CG', gb|EDZ37921.1|[5] | Rhodococcus fascians[7] |
| Bifidobacterium longum[5] | Leuconostoc sp.[1] | Rhodopseudomonas palustris[5] |
| Bifidobacterium longum DJO10A, ref|ZP_00120992.1|[5] | Limnobacter thiooxidans[3] | Rickettsia-like sp.[1] |
| Blautia hansenii DSM 20583, ref|ZP_03548131.1|[5] | Luteibacter anthropi[3] | Roseateles depolymerans[3] |
| Bordetella sp.[1] | Luteimonas aestuarii[3] | Roseateles terrae[3] |
| Bosea vestrisii[3] | Lysobacter enzymogenes[11] | Roseovarius nubinhibens ISM, ref|ZP_00958912.1|[5] |
| Bradyrhizobium japonicum[7] | marine gamma proteobacterium HTCC2148, gb|EEB80372.1|[5] | Roseovarius sp. TM1035, ref|ZP_01880909.1|[5] |
| Bradyrhizobium japonicum USDA 110 (BAC53039)[5] | Massilia aerolata[3] | Rothia amarae[3] |
| Bradyrhizobium japonicum USDA 110 (BAC53039)[5] | Massilia albidiflava[3] | Ruminococcus bromii[3] |
| Bradyrhizobium japonicum USDA 110, ref|NP_769684.1|[5] | Massilia sp.[3] | Salinivibrio costicola[3] |
| Bradyrhizobium pachyrhizi[3] | Mesorhizobium loti MAFF303099 (BAB54059)[5] | Salmonella enterica subsp. enterica serovar Dublin (ACH74415)[5] |
| Bradyrhizobium sp. BTAi1, ref|YP_001220569.1|[5] | Mesorhizobium loti MAFF303099 (BAB54059)[5] | Salmonella enterica subsp. enterica serovar Dublin (ACH74415)[5] |
| Bradyrhizobium sp. ORS278, ref|YP_001208056.1|[5] | Mesorhizobium sp. GWS-SE-H103[11] | Salmonella enterica subsp. enterica serovar Heidelberg (ACF66546)[5] |
| Brevibacillus agri[7] | Mesorhizobium tianshanense, gb|ACF28618.1|[5] | Sediminibacillus halophilus[3] |
| Brevibacterium frigoritolerans[3] | Methanospirillum hungatei JF-1, ref|YP_502123.1|[5] | Serratia liquefaciens[1] |
| Brevibacterium incertum[3] | Methylibium aquaticum[3] | Serratia marcescens[1] |
| Brevundimonas diminuta[3] | Methylobacterium aquaticum[4] | Serratia marcescens[3] |
| Brevundimonas naejangsanensis[3] | Bacterial endophytesReference | Serratia marcescens, sp|Q684Q1.1|LUXS_SERMA[5] |
| Brevundimonas sp.[12] | Methylobacterium brachiatum[7] | Serratia marcescens, emb|CAJ86499.1|[5] |
| Brevundimonas sp.[3] | Methylobacterium extorquens, gb|ABI17430.1|[5] | Serratia plymuthica[1] |
| Burkholderia cepacia[1] | Methylobacterium nodulans ORS 2060 (ACL62186)[5] | Serratia proteamaculans[1] |
| Burkholderia diffusa[3] | Methylobacterium nodulans ORS 2060 (ACL62186)[5] | Serratia sp.[1] |
| Burkholderia fungorum[7] | Methylobacterium oryzae[11] | Serratia ureilytica[3] |
| Burkholderia ginsengisoli[3] | Methylobacterium platani[3] | 55 |

TABLE B-continued

BACTERIAL ENDOPHYTES

| | | |
|---|---|---|
| *Burkholderia gladioli*[3] | *Methylobacterium radiotolerans*[7] | *Shewanella amazonensis* SB2B, ref|YP_928287.1|[5] |
| *Burkholderia gladioli*[1] | *Methylobacterium rhodesianum*[3] | *Shewanella* sp.[1] |
| *Burkholderia phymatum* STM815, ref|YP_001857126.1|[5] | *Methylobacterium* sp.[1] | *Shigella flexneri*[3] |
| *Burkholderia phytofirmans*[13] | *Methylobacterium zatmanii*[1] | *Shigella* sp.[1] |
| *Burkholderia phytofirmans*[7] | *Methylococcus capsulatus* str. Bath (AAU91441)[5] | *Shinella zoogloeoides*[3] |
| *Burkholderia phytofirmans*[3] | *Methylococcus capsulatus* str. Bath (AAU91441)[5] | *Sinorhizobium medicae* WSM419, ref|YP_001327237.1|[5] |
| *Burkholderia pickettii*[1] | *Methylophilus methylotrophus*[3] | *Sphingobacterium daejeonense*[3] |
| *Burkholderia plantarii*[3] | *Microbacterium arborescens*[11] | *Sphingobium herbicidovorans*[11] |
| *Burkholderia* sp.[3] | *Microbacterium binotii*[11] | *Sphingomonas aromaticivorans*[14] |
| *Burkholderia vietnamiensis*[5] | *Microbacterium hominis*[11] | *Sphingomonas aurantiaca*[12] |
| *Candidatus Rhizobium*[3] | *Microbacterium imperiale*[1] | *Sphingomonas dokdonensis*[3] |
| *Capnocytophaga* sp.[1] | *Microbacterium oleivorans*[2] | *Sphingomonas echinoides*[3] |
| *Caulobacter crescentus* NA1000 (ACL97137)[5] | *Microbacterium oxydans*[6] | *Sphingomonas echinoides*[10] |
| *Caulobacter crescentus* NA1000 (ACL97137)[5] | *Microbacterium takaoensis*[11] | *Sphingomonas humi*[3] |
| *Caulobacter* sp.[1] | *Microbacterium testaceum*[11] | *Sphingomonas koreensis*[3] |
| *Cedecea davisae*[3] | *Microbacterium trichotecenolyticum*[11] | *Sphingomonas melonis*[11] |
| *Cellulomonas denverensis*[7] | *Microbacterium trichothecenolyticum*[11] | *Sphingomonas melonis*[4] |
| *Cellulomonas* sp.[1] | *Micrococcus luteus*[7] | *Sphingomonas parapaucimobilis*[10] |
| *Cellvibrio japonicus* Ueda107 (ACE84205)[5] | *Micrococcus luteus*[6] | *Sphingomonas paucimobilis*[1] |
| *Cellvibrio japonicus* Ueda107 (ACE84205)[5] | *Micrococcus luteus*[4] | *Sphingomonas* sp. M3C203B-B[12] |
| *Cellvibrio mixtus*[3] | *Micrococcus* sp.[1] | *Sphingomonas* sp. SKA58 (EAT09931)[5] |
| *Cellvibrio* sp.[14] | *Micrococcus varians*[1] | *Sphingomonas* sp. SKA58 (EAT09931)[5] |
| *Chitinophaga pinensis* DSM 2588, ref|ZP_04357604.1|[5] | *Microscilla marina* ATCC 23134, ref|ZP_01688989.1|[5] | *Sphingomonas subterranea*[14] |
| *Chlorobium tepidum* TLS (AAM72443)[5] | *Microvirga aerilata*[3] | *Sphingomonas yabuuchiae*[4] |
| *Chlorobium tepidum* TLS (AAM72443)[5] | *Microvirga aerophilus*[3] | *Sphingomonas yanoikuyae*[2] |
| *Chryseobacterium hominis*[3] | *Moraxella acinetobacter*[1] | *Sphingomonas yanoikuyae*[3] |
| *Chryseobacterium* sp.[1] | *Moraxella* sp.[6] | *Sphingopyxis panaciterrae*[3] |
| *Chryseobacterium* sp.[3] | *Mycobacterium abscessus*[2] | *Sphingosinicella* sp.[3] |
| *Citrobacter braakii*[7] | *Mycobacterium cosmeticum*[11] | *Sphingosinicella xenopeptidilytica*[3] |
| *Citrobacter freundii*[7] | *Mycobacterium smegmatis* str. MC2 155 (ABK70727)[5] | *Staphyloccus hominis*[1] |
| *Citrobacter koseri*[5] | *Mycobacterium smegmatis* str. MC2 155 (ABK70727)[5] | Staphylococcuscohnii[3] |
| *Citrobacter koseri* ATCC BAA-895, ref|YP_001452611.1|[5] | *Mycobacterium vanbaalenii*[5] | *Staphylococcus capitis*[3] |
| *Citrobacter koseri* ATCC BAA-895, ref|YP_001455544.1|[5] | *Myxococcus xanthus* DK 1622, ref|YP_629504.1|[5] | *Staphylococcus epidermidis*[11] |
| *Citrobacter* sp.[1] | *Neisseria meningitidis*[2] | *Staphylococcus epidermitis*[6] |
| *Clavibacter michiganensis*[12] | *Nitrobacter hamburgensis* X14 (ABE64325)[5] | *Staphylococcus hominis*[3] |
| *Clostridium acetobutylicum*[7] | *Nitrobacter hamburgensis* X14 (ABE64325)[5] | *Staphylococcus lugdunensis*[11] |
| *Clostridium acetobutylicum* ATCC 824, ref|NP_349544.1|[5] | *Nitrobacter winogradskyi* Nb-255, ref|YP_318852.1|[5] | *Staphylococcus* sp.[1] |
| *Clostridium beijerinckii*[7] | *Nocardia farcinica* IFM 10152 (BAD60391)[5] | *Stenotrophomomonas* sp.[1] |
| *Clostridium beijerinckii* NCIMB 8052, ref|YP_001308375.1|[5] | *Nocardia farcinica* IFM 10152 (BAD60391)[5] | *Stenotrophomonas maltophilia*[7] |
| *Clostridium botulinum* B1 str. Okra, ref|YP_001780987.1|[5] | *Nocardia ignorata*[3] | *Stenotrophomonas maltophilia*[2] |
| *Clostridium butyricum* 5521, ref|ZP_02626830.2|[5] | *Nocardia soli*[3] | *Stenotrophomonas maltophilia* K279a, ref|YP_001972030.1|[5] |
| *Clostridium leptum* DSM 753, ref|ZP_02079097.1|[5] | *Nocardia* sp.[1] | *Stenotrophomonas maltophilia*, gb|ABM53767.1|[5] |
| *Clostridium ramosum* DSM 1402, ref|ZP_02429609.1|[5] | *Nostoc punctiforme* PCC 73102, ref|YP_001869999.1|[5] | *Stenotrophomonas pavanii*[3] |
| *Clostridium* sp. SS2/1, ref|ZP_02439410.1|[5] | *Nostoc* sp. PCC 7120, ref|NP_484408.1|[5] | *Steroidobacter denitrificans*[3] |
| *Clostridium* spp.[15] | *Oceanibaculum pacificum*[3] | *Stigmatella aurantiaca* DW4/3-1, ref|ZP_01462709.1|[5] |
| *Cohnella yongneupensis*[11] | *Ochrobaceterium anthropi*[1] | Streptococcusthermophilus[5] |

TABLE B-continued

BACTERIAL ENDOPHYTES

| | | |
|---|---|---|
| Collinsella aerofaciens[5] | Ochrobactrum grignonense[2] | Streptococcus thermophilus LMG 18311, ref\|YP_138642.1\|[5] |
| Collinsella aerofaciens ATCC 25986, ref\|ZP_01773331.1\|[5] | Ochrobactrum pseudogrignonense[3] | Streptomyces avermitilis MA-4680, ref\|NP_824495.1\|[5] |
| Colwellia psychrerythraea 34H, ref\|YP_271045.1\|[5] | Ochrobactrum tritici[2] | Streptomyces bottropensis[12] |
| Comamonas sp.[1] | Oxalophagus oxalicus[3] | Streptomyces cyaneus[14] |
| Comanomonas testosteroni[1] | Paenibacillus agarexedens[11] | Streptomyces kathirae[14] |
| Coryebacterium sp.[1] | Paenibacillus amylolyticus[4] | Streptomyces lincolnensis[14] |
| Corynebacterium pseudogenitalium[3] | Paenibacillus barcinonensis[11] | Streptomyces nodosus[14] |
| Corynebacterium sp.[3] | Paenibacillus caespitis[7] | Streptomyces scabies[14] |
| Cronobacter turicensis[3] | Paenibacillus chondroitinus[11] | Streptomyces sp.[1] |
| Cupriavidus campinensis[11] | Paenibacillus daejeonensis[3] | Streptomyces turgidiscabies[14] |
| Cupriavidus gilardii[3] | Paenibacillus humicus[2] | Sulfitobacter sp. NAS-14.1, ref\|ZP_00963622.1\|[5] |
| Curtobacterium citrenum[1] | Paenibacillus macerans[1] | Synechococcus sp. WH 5701 (EAQ76095)[5] |
| Curtobacterium citreum[2] | Paenibacillus nanensis[3] | Synechococcus sp. WH 5701 (EAQ76095)[5] |
| Curtobacterium flaccumfaciens[6] | Paenibacillus phyllosphaerae[11] | Tatumella morbirosei[3] |
| Curtobacterium flaccumfaciens[4] | Paenibacillus polymyxa[7] | Tepidimonas aquatic[3] |
| Curtobacterium flaccumfaciens[1] | Paenibacillus ruminocola[7] | Thermomonas brevis[3] |
| Curtobacterium herbarum[2] | Paenibacillus sp.[6] | Thermomonas koreensis[3] |
| Curtobacterium leteum[1] | Paenibacillus sp.[1] | Thiobacillus aquaesulis[3] |
| Curtobacterium sp.[1] | Paenibacillus sp. JDR-2 (EDS55035)[5] | Thiobacter subterraneus[3] |
| Curvibacter gracilis[3] | Paenibacillus sp. JDR-2 (EDS55035)[5] | Undibacterium sp.[3] |
| Cyanothece sp. PCC 7425, ref\|YP_002483742.1\|[5] | Paenibacillus taejonensis[3] | Variovorax boronicumulans[3] |
| Deinococcus ficus[2] | Paenibacillus xylanilyticus[3] | Variovorax sp.[1] |
| Deinococcus geothermalis DSM 11300 (ABF44161)[5] | Pandoraea sputorum[11] | Verrucomicrobiae bacterium DG1235, gb\|EDY84015.1\|[5] |
| Deinococcus geothermalis DSM 11300 (ABF44161)[5] | Pandoraea sputorum[3] | Vibrio sp.[3] |
| Deinococcus grandis[7] | Pantoea agglomerans[2] | Vibrio sp.[1] |
| Deleya sp.[1] | Pantoea agglomerans[3] | Xanthomonas albilineans[11] |
| Delftia acidovorans[11] | Pantoea agglomerans[1] | Xanthomonas axonopodis pv. citri str. 306, ref\|NP_642203.1\|[5] |
| Desemzia incerta[3] | Pantoea ananatis[7] | Xanthomonas campestris[1] |
| Devosia insulae[3] | Pantoea ananatis[10] | Xanthomonas campestris pv. campestris str. B100, ref\|YP_001903550.1\|[5] |
| Devosia riboflavina[3] | Pantoea ananatis[4] | Xanthomonas oryzae[1] |
| Dokdonella sp.[3] | Pantoea anthophila[3] | Xanthomonas oryzae emb\|CAA66459.1\|[5] |
| Dyella ginsengisoli[2] | Pantoea dispersa[7] | Xanthomonas oryzae pv. oryzae KACC10331, ref\|YP_201507.1\|[5] |
| Enhydrobacter aerosaccus[3] | Pantoea dispersa[3] | Xanthomonas sacchari[3] |
| Enterobactersp.[1] | Pantoea eucalypti[3] | Xanthomonas sp.[1] |
| Enterobacter aerogenes[7] | Pantoea sp.[1] | Xanthomonas translucens[4] |
| Enterobacter agglomerans[1] | Pasteurella sp.[1] | Yersinia frederiksenii[1] |
| Enterobacter amnigenus[3] | Pedobacter panaciterrae[11] | Yersinia sp.[1] |
| Enterobacter arachidis[2] | Pelomonas puraquae[3] | Zymomonas mobilis subsp. mobilis ZM4 (AAV89684)[5] |
| Enterobacter asburiae[7] | Perlucidibaca piscinae[3] | Zymomonas mobilis subsp. mobilis ZM4 (AAV89684)[5] |
| Enterobacter cancerogenus[3] | Phenylobacterium zucineum[5] | |
| Enterobacter cloacae[1] | Phenylobacterium zucineum HLK1, ref\|YP_002128524.1\|[5] | |

Reference Guide

Reference 1  Hurst, Christon J., et al. *Manual of environmental microbiology*. No. Ed. 3. ASM press, 2007
Reference 2  Hardoim, P. R., et al. (2012) PLoS ONE 7(2): e30438.
Reference 3  Liu, Y., et al. (2013) Annals of Microbiology, 63(1), 71-79.
Reference 4  Mano, H., et al. (2006) Microbes and Environment 21(2) 86-100
Reference 5  Sessitch, A. et al. (2012) MPMI 25(1) 28-36
Reference 6  Muhammad, N., et al. (2012) Endophytes E-COST FA1103 Working Group Meeting in Trento/S. Michele, Italy November 2012. (poster)
Reference 7  Johnston-Monje D, Raizada MN (2011) PLoS ONE 6(6): e20396.
Reference 8  Hurek, T., Reinhold-Hurek, B. (2003) J Biotechnol. 106(2-3): 169-78.
Reference 9  Engelhard M., et al. (2000) Environ Microbiol. (2): 131-41.
Reference 10  Okunishi, S., et al. (2005) Microbes and Environment 20(3) 168-177.
Reference 11  Johnston-Monje, D., et al. (2013) BMC Plant Biology (submitted).

-continued

| | |
|---|---|
| Reference 12 | Sessitch, A., et al. (2004) Canadian Journal of Microbiology 50:4. p: 239. |
| Reference 13 | Sessitch, A., et al. IJSEM May 2005 vol. 55 no. 3 1187-1192 |
| Reference 14 | Sessitch, A., et al. (2002) FEMS Microbiology Ecology 39: 23-32 |
| Reference 15 | Minamisawa K., et al. (2004) Appl Environ Microbiol. 70(5): 3096-102.; Reference 7 |
| Reference 16 | Seghers, D. (2004) APPLIED AND ENVIRONMENTAL MICROBIOLOGY 1475-1482 |
| Reference 17 | Bulgari, D., et al. (2009) The Journal of Microbiology p. 393-401 |
| Reference 18 | Verstraete 2004 |
| Reference 19 | AMANN R., FUCHS B. M. (2008): Single-cell identification in microbial communities by improved fluorescence in situ hybridization techniques. Nature reviews microbiology 6: 339-348 |
| Reference 20 | Chelius MK, Triplett EW (2001) The diversity of archaea and bacteria in association with the roots of Zea mays L. Microbial Ecology 41: 252-263 |
| Reference 21 | Edwards U, Rogall T, Blocker H, Emde M, Bottger EC (1989) Isolation and direct complete nucleotide determination of entire genes - Characterisation of a gene coding for 16S-ribosomal RNA. Nucleic Acids Research 17: 7843-7853. |
| Reference 22 | Prischl, M., Hackl, E., Pastar, M., Pfeiffer, S. and Sessitsch A. (2012) Genetically modified Bt maize lines containing cry3Bb1, cry1A105 or cry1Ab2 do not affect the structure and functioning of root-associated endophyte communities. Appl Soil Ecol 54, 39-48. |
| Reference 23 | NAVEED, M., MITTER B., YOUSAF S., PASTAR M., AFZAL M., SESSITSCH A. 2014. The endophyte Enterobacter sp. FD17: a maize enhancer selected based on rigorous testing of plant beneficial traits and colonization characteristics. Biology and Fertility of Soils 50: 249-262. |
| Reference 24 | Madi, L. and Henis, Y. (1989) Aggregation in Azospirillum brasilense Cd: conditions and factors involved in cell-to-cell adhesion. Plant Soil 115, 89-98. |
| Reference 25 | Rashid, M. H. and Kornberg, A. (2000) Inorganic polyphosphate is needed for swimming, swarming, and twitching motilities of Pseudomonas aeruginosa. Proc Natl Acad Sci USA 97, 4885-4890. |
| Reference 26 | Djordjevic, D., Wiedmann, M. and McLandsborough, L. A. (2002) Microtiter plate assay for assessment of Listeria monocytogenes biofilm formation. Appl Environ Microbiol 68, 2950-2958. |
| Reference 27 | Medina, P. and Baresi, L. (2007) Rapid identification of gelatin and casein hydrolysis using TCA. J Microbiol Methods 69, 391-393. |
| Reference 28 | Sarwar, M., M. Arshad, D. A. Martens and W. T. Jr. Frankenberger. 1992. Tryptophane-dependent biosynthesis of auxin in soil. Plant Soil, 147: 207-215. |
| Reference 29 | Feller et al., In: Meier U. (ed.) (2001): Growth stages of mono- and dicotyledonous plants. Federal Biological Research Center for Agriculture and Forestry, 2nd edition |
| Reference 30 | Mehta, S. and Nautiyal, C. S. (2001) An efficient method for screening phosphate solubilization bacteria. Curr Microbiol 43, 57-58. |
| Reference 31 | Rosado, A. S., De Azevedo, F. S., da Croz. D. W., Van Elas, J. D. and Seldin, L. (1998) Phenotypic and genetic diversity of Paenibacillus azatofeixans strains isolated from the rhizophere soil of different grasses. J Appl Microbiol 84, 216-226. |
| Reference 32 | Schwyn, B. and Neilands, J. B. (1987) Universal chemical assay for the detection and determination of siderophores. Anal Biochem 160, 47-56. |
| Reference 33 | Weaver, P. K., Wall, J. D. and Gest H. (1975) Characterization of Rhodpseudomonas capsulata. Arch Microbiol 105, 207-216. |
| Reference 34 | Cappuccino, J. G. and Sherman, N. (1992) Biochemical activities of microorganisms. In Microbiology, A Laboratory Manual. The Benjamin/Cummings Publishing Co. California, USA. |
| Reference 35 | Liu, M. Gonzalez, J. E., Willis, L. B.,. and Walker, G. C. (1998) A Novel Screening Method for Isolating Exopolysaccharide deficient Mutants. Appl Environ Microbiol 64, 4600-4602. |
| Reference 36 | Spiekermann, P., Rehm, B. H. A., Kalscheuer, R., Baumeister, D. and Steinbuchel, A. (1999) A sensitive, viable-colony staining method using Nile red for direct screening of bacteria that accumulate polyhydroxyalkanoic acids and other storage compounds. Arch Microbiol 171, 73-80. |
| Reference 37 | Cha, C., Gao, P., Chen, Y. C., Shaw, P. D. and Farrand, S. K. (1998). Production of acyl-homoserine lactone quorum-sensing signals by gram-negative plant associated bacteria. Mol Plant-Microbe Interact 11, 1119-1129. |
| Reference 38 | Männistö, M. K. and Häggblom, M. M. (2006) Characterization of psychrotolerant heterotrophic bacteria from Finnish Lapland. Syst Appl Microbiol 29, 229-243. |
| Reference 39 | Teather, R. M. and Wood, P. J. (1982) Use of congo red-polysacharide interactions in enumeration and characterization of cellulolytic bacteria in the bovine rumen. Appl Environ Microbiol 43, 777-780. |
| Reference 40 | Chernin, L. S., Winson, M. K., Thompson, J. M., Haran, S., Bycroft, B. W., Chet, I., Williams, P. and Stewart, G. S. A. B. (1998) Chitinolytic activity in Chromobacterium violaceum: Substrate analysis and regulation by quorum sensing. J Bacteriol 180, 4435-4441. |
| Reference 41 | Mateos, P. F., Jimenez-Zurdo, J. I., Chen, J., Squartini, A. S., Haack, S. K., Martinez-Molina, E., Hubbell, D. H. and Dazzo, F. B. (1992) Cell-associated pectinolytic and cellulolytic enzymes in Rhizobium leguminosarum biovar trifolii. Appl Environ Microbiol 58, 1816-1822. |
| Reference 42 | Abarenkov, K., R. Henrik Nilsson, K.-H. Larsson, I. J. Alexander, U. Eberhardt, S. Erland, K. Høiland, R. Kjøller, E. Larsson, T. Pennanen, R. Sen, A. F. S. Taylor, L. Tedersoo, B. M. Ursing, T. Vrålstad, K. Liimatainen, U. Peintner, and U. Kõljalg. 2010. The UNITE database for molecular identification of fungi - recent updates and future perspectives. New Phytologist 186: 281-285. |
| Reference 43 | Dunn, R. R., N. Fierer, J. B. Henley, J. W. Leff, and H. L. Menninger. 2013. Home life: factors structuring the bacterial diversity found within and between homes. PLoS One 8:e64133. |
| Reference 44 | Edgar, R. C. 2013. UPARSE: highly accurate OTU sequences from microbial amplicon reads. Nature methods 10: 996-8. |
| Reference 45 | Fierer, N., J. W. Leff, B. J. Adams, U. N. Nielsen, S. T. Bates, C. L. Lauber, S. Owens, J. a. Gilbert, D. H. Wall, and J. G. Caporaso. 2012. Cross-biome metagenomic analyses of soil microbial communities and their functional attributes. Proceedings of the National Academy of Sciences |

| Reference | Citation |
|---|---|
| Reference 46 | Lundberg, D. S., S. Yourstone, P. Mieczkowski, C. D. Jones, and J. L. Dangl. 2013. Practical innovations for high-throughput amplicon sequencing. Nature methods 10: 999-1002. |
| Reference 47 | McDonald, D., M. N. Price, J. Goodrich, E. P. Nawrocki, T. Z. DeSantis, A. Probst, G. L. Andersen, R. Knight, and P. Hugenholtz. 2012. An improved Greengenes taxonomy with explicit ranks for ecological and evolutionary analyses of bacteria and archaea. The ISME journal 6: 610-8. |
| Reference 48 | McGuire, K. L., S. G. Payne, M. I. Palmer, C. M. Gillikin, D. Keefe, S. J. Kim, S. M. Gedallovich, J. Discenza, R. Rangamannar, J. a Koshner, A. L. Massmann, G. Orazi, A. Essene, J. W. Leff, and N. Fierer. 2013. Digging the New York City Skyline: soil fungal communities in green roofs and city parks. PloS one 8:e58020. |
| Reference 49 | Wang, Q., G. M. Garrity, J. M. Tiedje, and J. R. Cole. 2007. Naive Bayesian classifier for rapid assignment of rRNA sequences into the new bacterial taxonomy. Applied and environmental microbiology 73: 5261-7. |
| Reference 50 | Edgar, R. C. 2010. Search and clustering orders of magnitude faster than BLAST. Bioinformatics 26: 2460-2461. |
| Reference 51 | Lundberg, D. S., S. L. Lebeis, S. H. Paredes, S. Yourstone, J. Gehring, S. Malfatti, J. Tremblay, A. Engelbrektson, V. Kunin, T. G. del Rio, R. C. Edgar, T. Eickhorst, R. E. Ley, P. Hugenholtz, S. G. Tringe, and J. L. Dangl. 2012. Defining the core Arabidopsis thaliana root microbiome. Nature 488: 86-90. |
| Reference 52 | R Core Team. 2013. R: A Language and Environment for Statistical Computing. R Foundation for Statistical Computing, Vienna, Austria. |
| Reference 53 | Massol-Deya A. A., Odelson D. A., Hickey R. F., Tiedje J. M. 1995. In: Molecular Microbial Ecology Manual. p289-296. Ed.: Akkermans A. D. L., Van Elsas J. D., De Bruijn F. J. Springer Netherlands. |
| Reference 54 | Wang K, Kang L, Anand A, Lazarovits G, Mysore KS. 2007. Monitoring in planta bacterial infection at both cellular and whole-plant levels using the green fluorescent protein variant GFPuv. New Phytol. 174(1): 212-23. |
| Reference 55 | Rodriguez RJ, Henson J, Van Volkenburgh E, Hoy M, Wright L, Beckwith F, Kim YO, Redman RS. 2008. Stress tolerance in plants via habitat-adapted symbiosis. ISME J. Apr; 2(4): 404-16. |

TABLE C

GenBank accession nOs of ADDITIONAL BACTERIAL ENDOPHYTES

| |
|---|
| AF226166 |
| AF226167 |
| AF226168 |
| AF226169 |
| AF226170 |
| AF226171 |
| AF226172 |
| AF226173 |
| AF226174 |
| AF226175 |
| AF226176 |
| AF226177 |
| AF226178 |
| AF226179 |
| AF226180 |
| AF226181 |
| AF226182 |
| AF226183 |
| AF226184 |
| AF226185 |
| AF226186 |
| AF226187 |
| AF226188 |
| AF226189 |
| AF226190 |
| AF226191 |
| AF226192 |
| AF226193 |
| AF226194 |
| AF226195 |
| AF226196 |
| AF226197 |
| AF226198 |
| AF226199 |
| AF226200 |
| AF226201 |
| AF226202 |
| AF226203 |
| AF226204 |
| AF226205 |
| AF226206 |
| AF226207 |
| AF226208 |
| AF226209 |
| AF226210 |
| AF226211 |
| AF226212 |
| AF226213 |
| AF226214 |
| AF226215 |
| AF226216 |
| AF226217 |
| AF226218 |
| AF226219 |
| AF226220 |
| AF226221 |
| AF226222 |
| AF226223 |
| AF226224 |
| AF226225 |
| AF226226 |
| AF226227 |
| AF226228 |
| AF226229 |
| AF226230 |
| AF226231 |
| AF226232 |
| AF226233 |
| AF226234 |
| AF226235 |
| AF226236 |
| AF226237 |
| AF226238 |
| AF226239 |
| AF226240 |
| AF226241 |
| AF226242 |
| AF226243 |
| AF226244 |
| AF226245 |
| AF226246 |
| AF226247 |
| AF226248 |
| AF226249 |

TABLE C-continued

GenBank accession nOs of ADDITIONAL BACTERIAL ENDOPHYTES

AF226250
AF226251
AF226252
AF226253
AF226254
AF226255
AF226256
AF226257
AF226258
AF226259
AF226260
AF226261
AF226262
AF226263
AF226264
AF226265
AF226266
AF226267
AF226268
AF226269
AF226270
AF226271
AF226272

TABLE D

FUNGAL GENERA

*Allodus, Allomyces, Allosoma, Aloysiella, Alphitomyces, Alternaria, Alveolaria, Alysisporium, Amallospora, Amanita, Amanitella, Amanitopsis, Amastigis, Amastigosporium, Amaurascus, Amazonia, Amblyosporiopsis, Amblyosporium, Ameghiniella, Ameris, Amerodothis, Amerosporiella, Amerosporis, Amerosporium, Anierostege, Amoebochytrium, Amorphomyces, Amphichaeta, Amphichaete, Amphichaetella, Amphiciliella, Amphicytostroma, Amphididymella, Amphiernia, Amphinectria, Amphischizonia, Amphisphaeria, Amphorula, Ampullaria, Amylirosa, Amylis, Anaphysmene, Anaptychia, Anapyrenium, Anariste, Anatexis,* Ancylistaceae, *Ancylistes, Andreaea, Andreaeana, Anellaria, Anema, Angatia, Angelinia, Angiopoma, Angiopomopsis, Anhellia, Anisochora, Anisogramma, Anisomjces, Anisomyxa, Anisostomula, Anixia, Anixiopsis, Annularia, Anomomyces, Anomorpha, Anomothallus, Antenella, Antenellina, Antennulariella, Anthina, Anthomyces, Anthomyces, Anthomycetella, Anthostoma, Anthostomaria, Anthostomella, Anthostomellina, Anthracoderma, Anthracoidea, Anthracophyllum, Anthracothecium, Anthurus, Antromyces, Antromycopsis, Anzia, Aorate, Aphanascus, Aphanomyces, Aphanomycopsis, Aphanopeltis, Aphanostigme, Aphysa, Apiocarpella, Apiocrea, Apiognomonia, Apioporthe, Apioporthella, Apiorhynchostoma, Apiosphaeria, Apiospora, Apiosporella, Apiosporina, Apiosporina, Apiosporium, Apiosporopsis, Apiotrabutia, Apiotypa, Aplacodina, Aplanes, Aplopsora, Apocytospora, Apodachlya, Apodya, Aponectria, Aporhytisma, Aporophallus, Aposphaeria, Aposphaeriella, Aposphaeriopsis, Aposporella, Apostemidium, Appendicularia, Apyrenium, Arachniopsis, Arachniotus, Arachnium, Arachnomyces, Arachnopeziza, Araeospora, Araneomyces, Arcangelia, Arcangeliella, Arctomia, Arenaea, Areolaria, Argomycetella, Argopsis, Argynna, Armatella, Armillaria, Arnaudiella, Arrhenia, Arrhytidia, Arthonia, Arthoniactis, Arthoniae, Arthoniopsis, Arthotheliopsis, Arthothelium, Arthrinium, Arthrobotryella, Arthrobotrys, Arthrobotryum, Artlirobotryum, Arthropyrenia, Arthropyreniella, Arthrorhynchus, Arthrosporium, Articularia, Articulariella, Articulis, Asbolisia, Aschersonia, Aschersoniopsis,* Ascobolaceae, *Ascobolae, Ascobolus, Ascocalathium, Ascochyta, Ascochytella, Ascochytopsis, Ascochytula, Ascochytulina, Ascocorticium, Ascodesmis, Ascoidea,* Ascoideaceae, *Ascomycetella, Ascomycetes, Ascophanae, Ascophanus, Ascopolyporus, Ascosorus, Ascospora, Ascostratum, Ascotricha, Aseroe, Ashbia, Aspergillae, Aspergillopsis, Aspergillus, Aspergillus, Asperisporium, Aspidopyrenis, Aspidopyrenium, Aspidothea, Aspidothelium, Asporomyces, Asterella, Asteridiella, Asteridiellina, Asteridium, Asterina,* Asterineae, *Asterinella, Asteristium, Asterocalyx, Asteroconium, Asterodon, Asterodothis. Asterolibertia, Asteroma, Asteromassaria, Asteromella, Asteromidium, Asteromyxa, Asteronaevia, Asteronia, Asteropeltis, Asterophlyctis, Asterophora, Asteroporum, Asteropsis, Asterosporium, Asterostomella, Asterostomula, Asterostroma, Asterostromella, Asterothyrium, Asterothyrium, Astraeus, Astrocystis, Astrodochium, Astrosphaeriella, Astrotheliae, Astrothelium, Atichia, Atopospora, Atractiella, Atractilina, Atractina, Atractium, Atrichophytum, Auerswaldia, Auerswaldiella, Auerswaldiopsis, Aulacostroma, Aulaxina, Aulographella, Aulographis, Aulographum, Aureobasidium, Aureobasis, Auricularia,* Auriculariaceae, *Auriculariclla, Autoecomyces, Avettaea, Bacidia, Bactrexcipula, Bactridiopsis, Bactridium, Bactrosphaeria, Bactrospora, Baculospora, Baeodromus, Baeomyces, Baeumleria, Baggea, Bagnisiella, Bagnisiopsis, Bakeromyces, Bakerophoma, Balansia, Balansiella, Balansina, Balansiopsis, Balladyna, Balladynella, Balladynopsis, Balsamia, Balzania, Barclayella, Bargellinia, Barlaea, Barlaeina, Barssia, Bartalinia, Barya, Basiascella, Basiascum, Basidiella, Basidiobolus, Basdiobotrys, Basidiomycetes, Basidiophora, Basilocula., Basisporium, Battarina, Battarrea, Battarreopsis, Bauniamniella, Baumiella, Beauveria, Beccariella, Beelia, Belonia, Belonidium, Beloniella. Belonioscypha, Belonioscyphella, Belonium, Bclonopeziza, Belonopsis, Belospora, Beltrania, Benguetia, Beniowskia, Berkelella, Berlesiella, Bertia, Bertiella, Bertiella, Biatora, Biatorella, Biatorellina, Biatorina, Bifusella, Bionectria, Bioporthe, Bioscypha, Biotyle, Bispora, Bisporella, Bivonella, Bizzozeria, Bizzozeriella, Blakeslea, Blasdalea, Blastenia, Blastocladia,* Blastocladiaceae, *Blastodendrum, Blastoderma, Blastodesmia, Blastomyces, Blastomycoides, Blastospora, Blastotrichum, Blennoria, Blennoriopsis, Blepharospora, Blodgettia, Bloxamia, Blumenavia, Blytridium, Bodinia, Boerlagella, Bolacotricha, Bolbitius, Boletinus, Boletogaster, Boletopsis, Boletus, Bolinia, Bolosphaera, Bombardia, Bombardiastrum, Bombardiella, Bombyliospora, Bommerella, Bonanseia, Bonia, Bonordeniella, Bonplandiella, Borenquenia, Bostrichonema, Bothrodiscus, Botrydiplis, Botryella, Botryochora, Botryoconis, Botryogene, Botryophoma, Botryorhiza, Botryosphaeria, Botryosphaerostroma, Botryosporium, Botryostroma, Botryotrichum, Botrysphaeris, Botrytidae, Botrytis, Bottaria, Boudiera, Boudierella, Bourdotia, Bovilla, Bovista, Bovistella, Bovistoides, Boydia, Brachyascus, Brachysporium, Brefeldiella, Bremia, Bremiella, Brencklea, Brenesiella, Bresadolella, Bresadolia, Bresadolina, Brevilegnia, Briardia, Briarea, Brigantiella, Briosia, Broomeia, Broomella, Brunchorstia, Bryophagus, Bryopogon, Bubakia, Buellia, Bulbothamnidium, Bulgaria,* Bulgariaceae, *Bulgariastrum,*

TABLE D-continued

FUNGAL GENERA

*Bulgariella, Bulgariopsis, Bullaria, Bullera, Bulliardella, Burkardia, Burrillia, Butleria, Byssocallis, Byssochlamys, Byssocystis, Byssogene, Byssolecania, Byssoloma, Byssolomae, Byssolophis, Byssonectria, Byssotheciella, Cacosphaeria, Cadophora, Caenomyces, Caenothyrium, Caeoma, Calathiscus, Calcarisporium, Caldariomyces, Caldesia, Caldesiella, Calenia, Caleniae,* Caliciaceae, *Caliciopsis, Calicium, Calidion, Calliospora, Calloria, Calloriella, Calloriopsis, Calocera, Calocladia, Caloderma, Calogloeum, CaloIepis, Calonectria, Calopactis, Calopeltis, Calopeziza, Calopeziza, Caloplaca, Calosphaeria, Calospora, Calosporella, Calostilbe, Calostilbella, Calostoma, Calothyriella, Calothyriolum, Calothyriopeltis, Calothyriopsis, Calothyris, Calothyriuni, Calotrichopsis, Calvatia, Calycella, Calycellina, Calycidium, Calyculosphaeria, Calyptospora, Calyptra, Calyptralegnia, Calyptronectri?., Camarographium, Camarops, Camarosporellum, Camarosporium, Camarosporulum, Camarotella, Camillea, Cainpanella, Campbellia, Campoa, Campsotrichum, Camptomeris, Camptomyces, Camptosphaeria, Camptoum, Campylothelium, Candelaria, Candelariella, Candelospora, Candida, Cantharellus, Cantharomyces, Cantharosphaeria, Capillaria, Capnites, Capnodaria,* Capnodiaceae, *Capnodiastrum, Capnodiella, Capnodina, Capnodinula, Capnodiopsis, Capnodium, Capnophaeum, Capnostysanus, Capronia, Carestiella, Carlia, Carlosia, Carothecis, Carpenteles, Caryospora, Casaresia, Castagnella, Castoreum, Catabotrys, Catacauma, Catacaumella, Catastoma, Catathelasma, Catenaria, Catenularia, Catharinia, Catilla, Catillaria, Catinaria, Catinella, Catinula, Catocarpus, Caudella, Caudospora, Caudosporella, Cauloglossum Causalis, Celidium, Celtidea, Cenangella, Cenangina, Cenangiopsis, Ctfnangium, Cenococcum, Cephaliophora, Cephalodochium, Cephalomyces, Cephalosporiae, Cephalosporium, Cephalotelium, Cephalotheca, Cephalothecium, Cephalotrichum, Ccracea, Ceraeomyces, Cerastomis, Ceratocarpia, Ceratochaete, Ceratochaetopsis, Ceratocladium, Ceratomyces,* Ceratomycetaceae, *Ceratophoma, Ceratophorum, Ceratoporthe, Ceratopycnidium, Ceratopycnis, Ceratopycnium, Ceratosperma, Ceratosphaeria, Ceratosporella, Ceratosporium, Ceratostoma, Ceratostomella, Cercidospora, Cercoseptoria, Cercosphaerella, Cercospora, Cercosporella, Cercosporidium, Cercosporina, Cercosporiopsis, Cerebella, Cerillum, Ceriomyces, Cerion, Ceriophora, Ceriospora, Ceriosporella, Cerocorticium, Cerotelium, Cesatiella, Cetraria, Ceuthocarpum, Ceuthodiplospora, Ceuthosira, Ceuthospora, Ceuthosporella, Chaconia, Chaenoderma, Chaenotheca, Chaetalysis, Chaetasbolisia, Chaetaspis, Chaetasterina, Chaetobasidiella, Chaetobasis, Chaetobotrys, Chaetoccratostoma, Chaetoceris, Chaetocladiae, Chaetocladium, Chaetoconidium, Chaetoconis, Chaetocrea, Chaetocytostroma, Chaetodiplis, Chaetodiplodia, Chaetodiplodina, Chaetodiscula, Chaetolentomita, Chaetomastia, Chaetomella, Chaetomeris, Chaetomidium, - Chaetomium, Chaetomyces, Chaetopcltiopsis, Chaetopeltis, Chaetopeltopsis, Chaetophiophoma, Chaetophoma, Chaetophomella, Chaetoplaca, Chaetoplea, Chaetopsis, Chaetopyrena, Chaetopyrenis, Chaetosclerophonia, Chaetoscypha, Chaetosira, Chaetospermum, Chaetosphaeria, Chaetosphaeronema, Chaetosphaeropsis, Chaetosticta, Chaetostigme, Chaetostigmella, Chaetostroma, Chaetostroma, Chaetostromella, Chaetostylum, Chaetotheca, Chaetothyrina, Chaetothyriolum, Chaetothyriopsis, Chaetothyrium, Chaetotrichum, Chaetozythia, Chaetyllis, Chalara, Chalaropsis, Chalcosphaeria, Chamonixia, Chantransiopsis, Charcotia, Charonectria, Charrinia, Cheilaria, Cheilymenia, Chelisporium, Chevaliera, Chevalieropsis, Chiajea, Chiastospora, Chiloella, Chilomyces, Chilonectria, Chiodectae, Chiodectum, Chiroconium, Chiromycella, Chiromyces, Chiropodium, Chitonia, Chitoniella, Chitonomyces, Chitonospora, Chlamydaleurosporia, Chlamydomucor, Chlamydomyces, Chlamydopus, Chlamydosporium, Chloridium, Chlorocaulum, Chlorodothis, Chloropeltis, Chlorophyllum, Chlorospleniella, Chlorosplenium, Chlorospora, Chnoopsora, Choanophora, Choanophorae, Choeromyces, Chondrogaster, Chondropodiella, Chondropodium, Choriactis, Chorostate, Chorostella, Chroinocrea, Chromocreopsis, Chromocytospora, Chromosporium, Chromotorula, Chrysella, Chrysocelis, Chrysocyclus, Chrysomyces, Chrysomyxa, Chrysopsora, Chrysothrix,* Chrysotrichaceae, Chytridiaceae, *Chytridiae,* Chytridiales, *Chytridium, Ciboria, CicadomyceSi Cicinnobella, Cicinnobolus, Cidaris, Ciferria, Ciliaria, Ciliciocarpus, Ciliciopodiuin, Ciliciopus, Ciliella, Ciliochora, Ciliofusa, Ciiiofusarium, Ciliomyces, Ciliophora, Ciliospora, Ciliosporella. Cintractia, Cionothrix, Circinastruni, Circinella, Circinotrichum, Cirromyces, Cirsosia, Cirsosiella, Citromyccs, Cladobotryum, Cladochaete, Cladochytriae, Cladochytrium, Cladoderris, Cladographium, Cladonia,* Cladoniaceae, *Cladorhinum, Cladosphaeria, Cladosporium, Cladosterignia, Cladotrichum, Clarkeinda, Clasterosporium, Clathrella, Clathridium, Clathrococcum, Clathrogaster, Clathroporina, Clathrospora, Clathrotrichum, Clathrus, Claudopus, Claussenomyces, Claustula, Clavaria,* Clavariaceae, *Clavariopsis, Clavariopsis, Claviceps, Clavogaster, Clavularia, Clavulinopsis, Cleistophoma, Cleistosoma, Cleistosphaera, Cleistotheca, Cleistothecopsis, Clematomyces, Cleptomyces, Clidiomyces, Cliniconidium, Clinterium, Clintoniella, Cliostomum, Clistophoma, Clistosoma, Clistosphaera, Clistotheca, Clistothecopsis, Clithris, Clitocybe, Clitopilus, Clonostachyopsis, Clonostachys, Closteraleurosporia, Closterosporia, Clypeochorella, Clypeodiplodina, Clypeolella, Clypeolina, Clypeolina, riypeolopsis, Clypeolum, Clypeoporthc, Clypeoporthella, Clypeopycnis, Clypcoseptoria, Clypeosphaeria, Clypeostignia, Clypeostroma, Clypeothecium, Clypeotrabutia, Coccidiascus, Coccidiodes, Coccidomyces, Coccidophthora, Cocciscia, Coccobotrys, Coccocarpia, Coccochora, Coccochorella, Coccodiella, Coccodinium, Coccodiscus, Coccodothella, Coccodothis, Coccoidea, Coccoidella, Coccomycella, Coccomyces, Coccomyces, Coccomycetella, Cocconia, Cocconiopsis, Coccopeziza, Coccophacidium, Coccospora, Coccosporella, Coccosporium, Coccostroma, Coccostromopsis, Coccotrema, Coelographium, Coelomyces, Coelomycidium, Coelosphaeria, Coemansia, Coemansiella, Coenogonium, Coleodictyospora, Coleodictys, Coleonaema, Coleophoma, Coleopuccinia, Coleosporium, Coleroa, Collacystis, Collema,* Collemaceae, *Collemis, CoUemodes, Collemopsidium, Colletomanginia, Colletotrichella, Colletotrichopsis, Colletotrichum Collodochium, Collonaema, Collonaemella, Collybia, Collyria, Colpoma, Coipomella, Columnophora, Columnothyrium, Colus, Combea, Comesia, Comoclathris, Complectoria, Compsomyces, Confervales, Conida, Conidiascus, Conidiobolus, Coniella, Coniocarpum, Coniochaeta, Coniocybe, Coniodictyum, Coniophora, Coniophorella, Conioscypha, Coniosporium, Coniothecium, Coniothyrella, Coniothjriella, Coniothyrina, Coniothyrimila, Coniothyriopsis, Coniothyriopsis, Coniothyris, Coniothyrium, Conoplea, Conostroma, Conotheciella, Conotrema, Constantinella, Cookeina, Cookella, Copelandia, Copranophilus, Coprinopsis, Coprinus, Coprolepa, Cora, Corallodendrum, Corallomyces, Coraliomycetella, Cordana, Cordelia, Cordierites, Corditubera,*

TABLE D-continued

FUNGAL GENERA

*Cordyceps, Corella, Coremiella, Coremium, Coreomyces, Corethromyces, Corethropsis, Cornicularia, Corniculariella, Cornucopiella, Cornuella, Cornularia, Corollium, Corollospora, Coronella, Coronophora, Coronophorella, Coronotelium, Corticium, Cortinarius, Corymbomyces, Coryne, Corynelia,* Coryneliaceae, *Corynelielia, Corynespora, Corynetes, Coryneum, Coscinaria, Coscinopeltis, Cosmariospora, Coutinia, Couturea, Crandallia, Craterellus, Craterocolla, Creomelanops, Creonectria, Creosphaeria, Creothyrium, Crepidotus, Criella, Crinula, Crinula, Criserosphaeria, Cristulariella, Crocicreas, Crocynia, Cronartium, Crossopsora, Crotone, Crotonocarpia, Crucibulum, Crumenula, Cryphonectria, Cryptascus, Cryptica, Cryptobasidium, Cryptoceuthospora, Cryptocline, Cryptococcus, Cryptocoryneum, Cryptoderis, Cryptodiaporthe, Cryptodidymosphaeria, Cryptodiscus, Cryptoleptosphaeria, Cryptomela, Cryptomycella, Cryptomyces, Cryptomycina, Cryptonectriopsis, Cryptopeltis, Cryptopeltosphaeria, Cryptopezia, Cryptophaella, Cryptophallus, Cryptoporus, Cryptopus, Cryptorhynchella, Cryptorhynchella, Cryptosphaerella, Cryptosphaeria, Cryptosphaerina, Cryptospora, Cryptosporella, Cryptosporina, Cryptosporiopsis, Cryptosporium, Cryptostictella, Cryptostictis, Cryptothecium, Cryptothele, Cryptothelium, Cryptovalsa, Ctenoderma, Ctenomyces, Cubonia, Cucurbidotliis, Cucurbitaria, Cucurbitariella, Cudonia, Cudoniella, Cutininghaniella, Cunninghamia, Curreya, Curreyella, Cuticularia, Cutomyces, Cyanobaeis, Cyanocephalum, Cyanochyta, Cyanoderma, Cyanophomella, Cyanospora, Cyathicula, Cyathus, Cycloconium, Cycloderma, Cyclodomus, Cyclodothis, Cyclographa, Cyclomyces, Cycloschizella, Cycloschizum, Cyclostoniella, Cyclotheca, Cyclothyrium, Cylindrina, Cylindrium, Cylindrocarpum, Cylindrocephalum, Cylindrocladium, Cylindrocolla, Cylindrodendrum, Cylindrophora, Cylindrosporelia, Cylindrosporium, Cylindrothyrium, Cylindrotrichum, Cylomyces, Cyniatella, Cyphelium, Cyphella, Cyphellomyces, Cyphellopycnis, Cyphina, Cyphospilea, Cystingophora, Cystodendrum, Cystolobis, Cystomyces, Cystophora, Cystopsora, Cystopus, Cystospora, Cystotelium, Cystotheca, Cystothyrium, Cystotricha, Cytidia, Cytodiplospora, Cytogloeum, Cytonaema, Cytophoma, Cytoplacosphaeria, Cytoplea, Cytosphaera, Cytospora, Cytosporella, Cytosporina, Cytosporium, Cytostaganis, Cytostaganospora, Cytotriplospora, Cyttaria,* Cyttariaceae, *Dacrymycella, Dacryobolus, Dacryodochium, Dacryomitra, Dacryomyces,* Dacryomycetaceae, *Dacryopsella, Dacryopsis, Dactylaria, Dactylella, Dactylina, Dactylium, Dactylomyces, Dactylosporium, Daedalea, Daldinia, Daleomyces, Dangeardia, Dangeardiella, Darbishirella, Darluca, Darlucis, Darwiniella, Dasybolus, Dasypezis, Dasyphthora, Dasypyrena, Dasyscypha, Dasyscyphae, Dasyscyphella, Dasysphaeria, Dasyspora, Dasysticta, Dasystictella, Davincia, Davinciella, Davisiella, Dearnessia, Debaryella, Debaryoniyces, Deconica, Delacourea, Delastria, Delastriopsis, Delitschia, Delitschiella, Delortia, Delphinella, Delpinoella, Delpontia,* Dematiaceae, - *Dematium, Dendrocladium, Dendrocyphella, Dendrodochium, Dendrodomus, Dendroecia, Dendrogaster, Dendrographa, Dendrographium, Dendrophoma, Dendrosphaera, Dendrostilbella, Dendrothele, Dendryphiella, Dendryphium, Dermatea,* Dermateaceae, *Dermatella, Dermatina, Dermatiscum, Dermatocarpae, Dermatocarpum, Dermatodothis, Dermophyta, Desmazierella, Desmella, Desmidiospora, Desmopatella, Desmotascus, Detonia, Deuteromycetes, Dexteria, Diabole, Diachora, Diachorella, Dialhypocrea, Dialonectria, Diaphanium, Diaporthe, Diaporthella, Diaporthopsis, Diarthonis, Diathryptum, Diatractium, Diatrype, Diatrypella, : Dibaeis, Dibelonis, Diblastospermella, Diblepharis. Dicaeoma, Dicarpella, Dichaena, Dichaenopsis, Dichaetis, Dichirinia, Dichlaena, Dichlamys, Dichomera, Dichomyces, Dichoporis, Dichosporium, Dichostereum, Dichothrix, Dichotomella, Dichotonium, Dicoccum, Dicollema, Dicranidium, Dicranophora, Dictyobole, Dictyocephalus, Dictyochaeta, Dictyochora, Dictyochorella, Dictyodothis, Dictyographa, Dictyolus, DictyomoUis, Dictyonella, Dictyonema, Dictyonia,* Dictyopeltineae, *Dictyopeltis, Dictyophora, Dictyorinis, Dictyosporium, Dictyothyriella, Dictyothyrina, Dictyothyrium, Dictyuchus, Dicyma, Didothis, Didymaria, Didymariopsis, Didymascella, Didymascella, Didymascina, Didymascus, Didymella, Didymellina, Didymellopsis, Didymobotryopsis, Didymobotrys, Didymobotryum, Didymochaete, Didymochlamys, Didymochora, Didymocladium, Didymocoryne, Didymopsamma, Didymopsis, Didymopsora, Didymosphaeria, Didymosporiella, Didymosporina, Didymosporis, Didymosporium, Didymostilbe, Didymothozetia, Didymotricha, Didymotrichum, Diedickea, Diedickella, Dielsiella, Dietelia, Digraphis, Dilophia, Dilophospora, Dimargaris, Dimeriella, Dimeriellopsis, Dimerina, Dimerinopsis, Dimeriopsis, Dimerisma, Dimerium, Dimeromyces, Dimerosporiella, Dimerosporina, Dimerosporiopsis, Dimerosporium, Dimorphomyces, Dinemasporiella, Dinemasporiopsis, Dinemasporis, Dinemasporium, oecomyces, oranotropis, orchidium, phaeis, phaeostica, phanis, phanosticta, phloeis, plocarpa, plocarpum, ploceras, plochora, plochorella, plocladium, plococcium, plocryptis, plocystis, plodascus, ploderma, plodia, plodiella, plodina, plodinis, plodiopsis, plodothiorella, plogramma, ploidium, plomyces, plonaevia, ploospora, plopeltis, plopeltis, plopeltopsis, plophlyctis, plophysa, ploplacis, ploplacosphaeria, ploplenodomopsis, ploplenodomus, plorhinotrichum, ploschistes, plosclerophoma, plosphaerella, plosporis, plosporium, plostephanus, plotheca, plotomma, plozythia, plozythiella, porina, pyrenis, rina, rinae, rinaria, rinastrum, saeta, scella,* scellaceae, *scellae, scina, sciseda, scocera, scochora, scocolla, scocyphella, scodiaporthe, scodothis, scofusarium, scogloeum, scomycella, scomycopsella, scomycopsis, scosia, scosiella, scosphaerina, scosporella, scosporiella, scosporiopsis, scosporium, scostroma, scostromella, scotheciella, scothecium, Discozythia, Discula, Disculina, Disperma, Dispira, Dissophora, Distichomyces, Dithelopsis, Dithozetia, Ditiola, Ditopella, Ditremis, Ditylis, Doassansia, Doassansiopsis, Doratomyces, Dothichiza, Dothichloe, Dothiclypeolum, Dothidasteris, Dothidasteroma, Dothidasteromella, Dothidea,* Dothideaceae, Dothideae, *Dothideales, Dothidella, Dothideodiplodia, Dothideopsella, Dothideovalsa, Dothidina, Dothidotthia, Dothiopsis, Dothiora, Dothiorae, Dothiorellina, Dothiorina, Dothisphaeropsis, Dothithyriella, Dothophaeis, Drepanoconis, Drepanopeziza, Drepanospora, Dubiomyces, Ductifera, Dufourea, Duplicaria, Duportella, Durandia, Durandiomyces, Durella, Dussiella, Dyslachnum, Dyslecanis, Dysrhynchis, Dysticta, Dystictina, Earlea, Ecchyna, Eccilia, Echidnodella, Echidnodes, Echinobotryum, Echinodontium, Echinodothis, Echinophallus, Echinothecium, Echusias, Ectinomyces, Ectosphaeria, Ectosticta, Ectostroma, Ectotrichophytum, Ectrogella, Eichleriella, Eidamella, Elachopeltis, Elaeodema, Elaphomyces,* Elaphomycetaceae, *Elasmomyces, Elateromyces, Eleutheris, Eleutheromycella, Eleutheromyces, Eleutherosphaera, Ellisiella, Ellisiodothis, Elmeria, Elmerina, Elmerococcum, Elsinoae, Elsinoe, Emericella, Empusa,* Empusaceae, *Enantiothamnus,*

TABLE D-continued

FUNGAL GENERA

*Enarthromyces, Encephalographa, Enchnoa, Enchnosphaeria, Encoelia, Encoeliella, Endobasidium, Endoblastoderma, Endobotrya, Endobotryella, Endocalyx, Endocarpum, Endocena, Endocladis, Endococcus, Endoconidiophora, Endoconidium, Endocoryneum, Endocycia, Endodermophytum, Endodesmia, Endodothella, Endodothiora, Endogloea,* Endogonaceae, *Endogone, Endogonella, Endomyces,* Endomycetaceae, *Endophragmia, Endophyllachora, Endophylloides, Endophyllum, Endoscypha, Endospora, Endostigme, Endothia, Endothiella, Endoxyla, Endoxylina, Endyllium, Englerodothis, Engleromyces, Englerula,* Englerulaceae, *Englerulaster, Enterodictyum, Enterostigma, Enthallopycnidium, Entodesmium, Entoleuca, Entoloma, Entomopatella, Entomophthora, Entomosporium, Entonaema, Entopeltis, Entophlyctis, Entorhiza, Entosordaria, Entyloma, Eocronartium, Eolichen, Eomycenella, Eosphaeria, Eoterfezia, Ephebae, Ephebe, Ephebeia, Ephelidium, Ephelina, Epheliopsis, Epheliopsis, Ephelis, Epibotrys, Epichloe, Epiclinium, Epicoccum, Epicorticium, Epicymatia, Epicyta, Epidermidophyton, Epidermophytum, Epidochiopsis, Epidochium, Epigloea, Epilichen, Epinectria, Epipeltis, Epiphora, Epiphyma, Epipolaeum, Episoma, Episphaerella, Epistigme, Epithele, Epochnium, Eremascus, Eremotheca, Eremothecella, Eremothecium, Erikssonia, Erinella, Erioderma, Eriomene, Eriomenella, Eriomycopsis, Eriopeziza, Eriosphaeria, Eriospora, Eriosporangium, Eriosporella, Eriosporina, Eriothyrium, Erostella, Erostrotheca,* Erysiphaceae, *Erysiphe, Erysiphella, Erysiphopsis, Erysiphopsis, Erythrocarpum, Euacanthe, Euantennaria, Eubelonis, Eucantharomyces, Euchaetomella, Eucorethromyces, Eucyphelis, Eudarluca, Eudimeriolum, Euhaplomyces, Eumela, EumoUisiae, Eumonoecomyces, Eupelte, Eupropolella, Europolis,* Eurotiaceae, *Eurotiella, Eurotiopsis, Eurotium, Euryachora, Eurychasma, Eurytheca,* Eusticitidae, *Euthryptum, Eutorula, Eutorulopsis, Eutypa, Eutypella, Eutypopsis, Euzodiomyces, Everhartia, Evernia, Everniopsis, Exarmidium,* Exascaceae, *Exascus, Excioconis, Excipula,* Excipulaceae, *Excipularia, Excipulella, Excipulina, Exidia, Exidiopsis, Exilospora, Exobasidiopsis, Exobasidium, Exogone, Exophoma, Exosporella, Exosporina, Exosporina, Exosporium, Exotrichum, Fabraea, Fairmania, Fairmaniella, Falcispora, Farlowiella, Farriola, Farysia, Favillea, Favolus, Ferns jonia, Fenestella, Feracia, Ferrarisia, Filoboletus, Fimetaria, Fioriella, Fischerula, Fistulina, Fistulinella, Flageoletia, Flaminia, Flammula, Fleischeria, Fleischhakia, Floccomutinus, Fomes, Fominia, Forssellia, Fouragea, Fracchiaea, Fragosoa, Fragosoella, Fragosphaeria, Friesula, Frommea, Fuckelia. Fuckelina, Fulininaria, Fumago, Fumagopsis, Fumagospora, Fusariella, Fusarium, Fusella. Fusicladiella, Fusicladium, Fusicoccum, Fusicolla, Fusidium, Fusisporella, I Fusoma, Gaillardiella, Galactinia, Galera, Gallowaya, Galziiiia, Gambleola, Gamonaemella, Gamospora, Gamosporella, Ganoderma, Gastroboletus, Gautieria, Geaster, Geasteroides, Geasteropsis, Geisleria, Gelatinosporis, Gelatinosporium, Geminispora, Genabea, Genea, Geoglossae, Geoglossum, Geolegnia, Geopora, Geopyxis, Geotrichum, Gerwasia, Gibbera, Gibberella, Gibberidea, Gibellia, Gibellina, Gibellula, Gibsonia, Gilletia, Gilletiella, Gillotia, Giulia, Glaziella, Glenospora, Gliobotrys, Gliocephalis, Gliocladium, Gliocladochium, Gliomastix, Glischroderma, Globaria, Globulina, Gloeocalyx, Gloeocephala, Gloeocystidium, Gloeodes, Gloeoglossum, Gloeopeniophora, Gloeopeziza, Gloeoporus, Gloeosoma, Gloeosphaera, Gloeosporidiella, Gloeosporidina, Gloeosporidium, Gloeosporiella, Gloeosporina, Gloeosporiopsis, Gloeosporium, Gloeothele, Glomerella, Glomerula, Glomerularia, Glomus, Gloniella, Gloniopsis, Glonium, Glossodium, Glutinium, Glycophila, Glyphis, Glypholecia, Gnomonia, Gnomoniella, Gnomonina, Gnomoniopsis, Godfrinia, Godronia, Godroniella, Godroniopsis, Gomphidius, Gomphillus, Gonapodya, Gonatobotrys, Gonatobotrytae, Gonatobotryum, Gonatorhodis, Gonatorhodum, Gongromeriza, Gongylia, Gonisporium, Gonisporiuni, Gonohymenia, Gonolecania, Gonothecis, Gonothecium, Gonyella, Gonytrichum, Goplana, Gorgoniceps, Grallomyces. Grammothele, Grandinia, Grandiniella, Granularia,* Graphidaceae, *Graphidae, Graphidium, Graphina, Graphinella, Graphiola,* Graphiolaceae, *Graphiopsis, Graphiothecium, Graphis, Graphium, Graphyllium, Griggsia, Griphosphaerella, Griphosphaeria, Griphosphaerioma, Groveola, Grubyella, Gueguenia, Guelichia, Guepinia, Guignardia, Guignardiella, Guillermondia, Giiillermondia, Guttularia, Guttularia, Gyalecta, Gyalectae,* Gymnascaceae, *Gymnascales, Gymnascus, Gymnoconia, Gymnoderma, Gymnodochium, Gymnoglossum,* GymnograpHa_Gyninomyces, *Gymnopeltis, Gymnosporangium, Gymnotelium, Gyrocephalus, Gyroceras, GyrocoUema, Gyrocratera, Gyrodon, Gyromitra, Gyrophora, Gyrophorae, Gyrophragmium, Gyrostomum, Gyrostroma, H Habrostictis, Hadotia, Hadronema, Hadrotrichum, Haematomma, Haematomyces, Haematomyxa, Hainesia, Halbania, Halbaniella, Halbanina, Halobyssus, Halonia, Halstedia, Hamaspora, Hamasporella, Hansenia, Hanseniospora, Hansenula, Hapalocystis, Hapalophragmium, Hapalosphaeria, Haplaria, Haplariella, Haplariopsis, Haplariopsis, Haplobasidium, Haplodothella, Haplodothis, Haplographium, Haplolepis, Haplomela, Haplomyces,* Haplopeltineae, *Haplopeltis, Haplophyse, Haplopyrenula, Haplopyxis, Haploravenelia, Haplosporangium, Haplosporella, Haplosporidium, Haplosporium, Haplostroma, Haplotheciella, Haplothecium, Haplothelium, Haplotrichum, Haplovalsaria, Haraea, Hariotia, Hariotula, Harknessia, Harknessiella, Harpagomyces, Harpidium, Harpocephalum, Harpochytrium, Harpographium, Harposporella, Hartiella, Hartigiella, Harziella, Hassea, Hebeloma, Helicia, Helicobasidium, Helicobasis, Helicocephalum, Helicodendrum, Helicodesmus, Helicogloea, Helicoma, Helicomyces, Helicopsis, Helicosporangium, Helicosporium, Helicostilbe, Helicostylum, Helicotrichum, Helicoum, Heliomyces, Heliscus, Helminthocarpum, Helminthophana, Helminthosphaeria, Helminthosporium, Helolachnum, Helostroma,* Helotiaceae, *Helotiae, Helotiopsis, Helotium, Helvella,* Helvellaceae, *Helvellae, Hemidothis, Hemigaster, Hemiglossum, Hemileia, Hemileiopsis,* Hemisphaeriaceae, *Hemispora, Hendersonia, Hendersoniella, Hendersonina, Hendersoninula, Hendersoniopsis, Hendersonula, Henningsia, Henningsiella, Henningsina, Henningsomyces, Henriquesia, Heppia, Heppiae, Heptameria, Heptasporium, Hercospora, Hericium, Hermatomyces, Herpobasidium, Herpocladiella, Herpocladium, Herpomyces, Herpothrix, Herpotrichia, Herpotrichiella, Herpotrichiopsis, Heterobasidium, Heterobotrys, Heterobotrys, Heterocarpum, Heterocephalum, Heteroceras, Heterochaete, Heterochaetella, Heterochlamys, Heterodea, Heterodothis, Heteromyces, Heteronectria, Heteropatella, Heteropera, Heterophracta, Heteroplegma, Heterosphaeria, Heterosporium, Hetcrotcxtus, Hexagonella, Hexagonia, Heydenia, Heydeniopsis, Hiatula, Himantia, Hippoperdum, Hirneola, Hirneolina, Hirsutella, Hirundinaria, Histoplasma, Hobsonia, Hoehneliella, Hoehnelogaster, Hoehnelomyces, Holcomyces, Holocoenis, Holocyphis, Holothelis, Holstiella, Holwaya, Holwayella, Homopsella, Homostegia, Hormiactella,*

TABLE D-continued

FUNGAL GENERA

*Hormiactina, Hormiactis, Honiiisciopsis, Hormiscium, Horniococcus, Hormodendrum, Hormomyces, Hormonema, Hormopeltis, Hormosperma, Hormothecium, Hormylium, Hueella, Humaria, Humariella, Humarina, Husseya, Hyalasterina, Hyalinia, Hyaloceras, Hyalocrea, Hyalocurreya, Hyalodema, Hyaloderma, Hyalodermella, Hyalodictyum, Hyalodothis, Hyalomeliolina, Hyalopeziza, Hyalopsora, Hyalopus, Hyaloria, Hyaloscypha, Hyalosphaera, Hyalotexis, Hyalotheles. Hyalothyris,* Hydnaceae, *Hydnangium, Hydnobolites, Zll Hydnochaete, Hydnochaete, Hydnocystis, Hydnodon, Hydnofomes, Hydnotrya, Hydnotryopsis, m Hydnum, Hydraeomyces, Hydrogera, Hydroncctria, Hydrophilomyces, Hydrophora, Hydrothyria, Hygrophorus, Hymenella, Hymenobactrum. Hynienoboliis, Hymenochaete, Hymenogaster,* li Hymenogastraceae, *Hymenogramme, Hymenopsis, Hymenoscypha, Hymenula, Hyperomyxa, Hyperphyscia, Hyperus, Hypha, Hyphaster, Hyphochytriinii, Hyphoderma, Hyphodiscus, Hypholoma, Hyphoscypha, Hyphosoma, Hyphostereum, Hypocapnodium, Hypocelis, Hypocenia,* Hypochnaceae, *Hypochnus, Hypocopra, Hypocrea,* Hypocreaceae, *Hypocrella, Hypocreodendrum, Hypocreophis, Hypocreopsis, Hypoderma, Hypodermella, Hypodermellina, Hypodermina, Hypodermina, Hypodermium, Hypodermopsis, Hypogloeum, Hypolyssus, Hypomyces, Hypomycopsis. Hyponectria, Hypoplegma, Hypoplegma, Hypospila, Hypospilina, Hypostegium, Hypostigine, Hypoxylina, Hypoxylopsis, Hypoxylum, Hysterangium,* Hysteriaceae, *Hysteridiuiii, Hysterium, Hysteroglonium, Hysterographium, Hysteromyxa, Hystcropatella, Hysteropeltella, Hysteropeziza, Hysteropezizella, Hysteropsis, Hysteropsis, Hysterostegiella, Hysterostoma, Hysterostomella, Hysterostomina, Icmadophila, Idiomyces, Ijuhya, Ileodictyum, Illosporium, Indiella, Ingaderia, Inocybe, Inocyclus, Inzengaea, lotidea, Irene, Irenina, Irenopsis, Iridionia, Irpex, Isaria, Isariella, Isariopsis, Ischnostroma, Isipinga, Isoachlya, Isomunkia, Isomyces, Isothea, Isthmospora, Itajahya, Ithyphallus, Jaapia, Jackya, Jaczewskia, Jaczewskiella, Jaffuela, Jahniella, Jainesia, Janospora, Janseella, Jansia, Japonia, Jaraia, Jattaea, Jenmania, Johansonia, Jola, Jonaspis, Julella, K Kabatia, Kabatiella, Kalchbrennera, Kalmusia, Karschia, Karstenia, Karstenula, Kawakamia, Keissleria, Keissleriella, Keisslerina, Keithia, Kellermannia, Kerminicola, Khekia, Kickxella, Kirschsteinia, Kirschsteiniella, Klastospora, Klebahnia, Kleidiomyces, Kmetia, Kneiffia, Koerberia, Konenia, Konradia, Koordersiella, Kordyana, Kordyanella, Kretschmaria, Kriegeria, Kriegeriella, Kuehneola, KuUhemia, Kunkelia, Kuntzeomyces, Kupsura, Kusanoa, Kusanobotrys, Kusanoopsis, Laaseoniyces, Laboulbenia,* Laboulbeniaceae, Laboulbeniales, *Labrella, Labridium, -accocephalum. Lacellina, Lachnaster, Lachnea, Lachnella, Lachnellula, Lachnocaulum, Lachnocladium, Lachnodochium, Lachnum, Lactaria, Lactariopsis, Lactarius, Laestadia, Laestadiella, Lagena, Lagenidiopsis, Lagenidium, Lageniformia, Lagerheimia, Lagynodella, Lahmia, Lambertella, Lambottiella, Lambro, Lamia, Lamprospora, Lamyella, Langloisula, Lanomyces, Lanopila, Lanzia, Laquearia, Laschia, Lasiella, Lasiobelonis, Lasiobelonium, Lasiobolus, Lasiobotrys, Lasiodiplodia, Lasionectria, Lasiophoma, Lasiosordaria, Lasiosphaera, Lasiosphaeria, Lasiosphaeris, Lasiostemma, Lasiostictis, Lasiostroma, Lasiothyrium, Lasmenia, Lasmeniella, Latrostium, Latzelia, Laurera, Lauterbachiella, Leandria, Lecanactidae, Lecanactis, Lecania, Lecaniascus, Lecanidion, Lecaniopsis, Lecanora, Lecanorae, Lecanosticta, Lecidea,* Lecideaceae, *Lecideae, Lecideopsella, Lecideopsis, Lecidopyrenopsis, Lecioglyphis, Leciographa, Leciophysma, Lecithium, Lecopyrenopsis, Leeina, Leiosepium, Leiosphaerella, Lelujn, Lemalis, Lembosia, Lembosiella, Lembosina, Lembosiodothis, Lembosiopsis, Lemmopsis, Lemonniera, Lempholemma, Lentinus, Lentodiopsis, Lentodium, Lentomita, Lentomitella, Lenzites, Leotia, Leotiella, Lepidella, Lepidocollema, Lepidogium, Lepidoleptogium, Lepiota, Lepolichen, Lepraria, Leprieurina, LeprocoUema, Leptascospora, Lepteutypa, Leptinia, Leptobelonium, Leptochlamys, Leptocoryneum, Leptocrca, Leptodermella, Leptodothiora, Leptodothis, Leptogidium, Leptogiopsis, Leptogium, Leptoglossum, Leptographium, Leptolegnia, Leptomassaria, Leptomelanconium, Leptomeliola, Leptomitae, Leptomitus, Leptonia, Leptopeltella, Leptopeltina, Leptopeltis, Leptopeziza, Leptophacidium, Leptophoma, Leptophyma, Leptopuccinia, Leptorhaphis, Leptosacca, Leptosillia, Leptosphaerella, Leptosphaeria, Leptosphaeropsis, Leptosphaerulina, Leptospora, Leptosporella, Leptosporium, Leptosporopsis, Leptostroma,* Leptostromaceae, *Leptostromella, Leptothyrella, Leptothyrina, Leptothyrium, Leptotrema, Leptotrichum, Leptoxyphium, Letendraea, Letharia, Lethariopsis, Leucangium, Lcucobolites, Leucoconis, Leucoconius, Leucocrea, Leucocytospora, Leucodochium, Leucogaster, Leucopaxillus, Leucopezis, Leucophleps, Leucophomopsis, Leucostoma, Leucothyridium, Leveillella, Leveillina, Leveillinopsis, Leveillula, Levieuxia, Libertella, Libertiella, Libertina, Lichenoconium, Lichenopeltella, Lichenophoma, Lichenosticta, Lichenyllium, Lichina, Lichinae, Lichinella, Lichinodium, Lichtheimia, Licopolia, Ligniella, Ligniera, Lilliputia, Limacinia, Limacinia, Limaciniella, Limaciniopsis, Limnaeomyces, Lindauella, Lindauomyccs, Lindauopsis, T, indrothia, Linearistroma, Linhartia, Linkiclla, T. inoboliis, Linocarpum, Linochora, Linochorella, Linodochium, Linospora, IIT Linostoma, Linostomella, Linostroma, Linotexis, Lipospora, Lisea, Lisiella, Listeromyces, Lithoecea, Lithographa, Lithothelium, Litschaueria, Lituaria, Lizonia, Lizoniella, Lloydiella, Lobaria, Lobarina, Locellina, Loculistroma, Lojkania, Lonchospermella, Longia, ZZl Longoa, Lopadiopsis, Lopadium, Lopadostoma, Lopharia, Lophidiopsis, Lopliidium, Lophiella, Lophionema, Lophiosphaera, Lophiostoma,* Lophiostomaceae, *Lophiotrema, Lophiotricha, Lophium, Lophodermella, I. ophodermellina, T, ophoderniina, Lophodermium, Lophodermopsis, ill Lophophytum, Loramyces, Loranthomyces, Ludwigiella, Lulworthia, Lycogalopsis,* Lycoperdaceae, *Lycoperdales, Lycoperdellon, Lycoperdopsis, Lycoperdum, Lyonella, Lysospora, Lysurus, M Macalpinia, Macbridella, Macowaniella, Macowanites, Macrobasis, Macrochytrium, Macroderma, Macrodiaporthe, Macrodiplis, Macrodiplodia, Macrodiplodiopsis, Macrophoma, Macrophomella, Macrophomina, Macrophomopsis, Macroplodiella, Macropodia, Macroseptoria, Macrospora, Macrosporium, Macrostilbum, Madurella, Magnusia, Magnusiella, Magnusiomyces, Maireella, Malacodermis, Malacosphaeria, Malassezia, Malbranchea, Malmeomyces, Mamiana, Mamianella, Manginia, Manginula, Manilaea, Mapea, Marasniiopsis, Marasmius, Maravalia, Marchalia, Marchaliella, Marcosia, Maronea, Marsonia, Marsoniella, Marsonina, Martellia, Martensella, Martindalia, Martinella, Massalongia, Massalongiella, Massalongina, Massaria, Massariella, Massariellops, Massarina, Massarinula, Massariopsis, Massariovalsa, Masseea, Masseella, Massospora, Mastigocladium, Mastigonema, Mastigonetrum, Mastigosporella, Mastigosporium, Mastodia, Mastomyces, Matruchotia, Mattirolia, Matula, Maublancia, Mauginiella, Maurodothella,*

TABLE D-continued

FUNGAL GENERA

*Maurodothis, Maurya, Maxillospora,* Mazos-a, *Mazzantia, Alazzantiella, Medeolaria, Medusomyces, Medusulina, Megalonectria, Megalopsora, Megaloseptoria, Megalospora, Melachroia, Melampsora,* Melampsoraceae, *Melampsorella, Melampsoridium, Melampsoropsis, Melampydium,* Melanconiaceae, *Melanconiales, Melanconiella, Melanconiopsis, Melanconis, Melanconium, Melanidium, Melanobasidium, Melanobasis, Melanobotrys, Melanochlamys, Melanodiscus, Melanogaster, Melanographium, Melanomma, Melanomyces, Melanoplaca, Melanops, Melanopsamma, Melanopsammella, Melanopsammina, Melanopsammopsis, Melanopsichium, Melanosphaeria, Melanospora, Alelanosporopsis, Melanostroma, Melanotaenium, Melanotheca, Melasmia, Melaspilea, Melastiza, Melchiora, Meliola, Meliolaster, Meliolidium, Meliolina, Meliolinopsis, Melioliphila, Meliolopsis, Melittosporiella, Melittosporiopsis, Melittosporis, Melittosporium, Melogramma, li\Melomastia, Melophia, Memnoniella, Mendogia, Menezesia, Menispora, Menoidea, Merarthonis, Meria, Meringosphaeria, Merismatium, Merismella, Merodontis, Merophora, Meroplacis, Merorinis, Merostictina, Merostictis, Merrilliopeltis, Merulius, Mesniera, Mesobotrys, Mesonella, Mesophellia, Mesopsora, Metabotryum, Metacapnodium, Metachora, Metacoleroa, Metadothella, Metameris, Metanectria, Metasphaeria, Metathyriella, Methysterostomella, Metraria, Michenera, Micranthomyces, Micrascus, Microbasidium, Microcallis, Microcera, Microclava, Microcyclella, Microcyclus, Microdiplodia, Microdiscula, Microdiscus, Microdochium, Microdothella, Microglaena, Microgloeum, Microglossum, Micrographa, Micromastia, Micromyces, Micromycopsis, Micromyriangium, Micronectria, Micronectriella, Micronectriopsis, Micronegeria,* Micropeltaceae, *Micropeltella, Micropeltis, Micropeltopsis, Micropera, Microperella, Microphiale, Microphiodothis, Micropodia, Micropsalliota, Micropuccinia, Micropyrenula, Microscypha, Microspatha, Microsphaera, Microsphaeropsis, Microsporella, Microsporum, Microstelium, Microsticta, Microstroma, Microthecium, Microthelia, Microtheliopsis,* Microthyriaceae, *Microthyriales,* Microthyrieae, *Microthyriella, Microthyriolum, Microthyris, Microthyrites, Microthyrium, Microtyle, Microtypha, Microxyphium, Microxyphiella, Micula, Midotiopsis, Midotis, Milesia, Milesina, Milowia.* Mindemella, *Minksia, Mitochytridium, Mitochytrium, Mitopeitis, Mitosporium, Mitromyces, Mitrula, Mitruliopsis, Miyabella, Miyagia, Miyakeaniyces, Miyoshia, Miyoshiella, Moelleriella, Moelleroclavus, Moellerodiscus, Moeszia, Moesziella, Mohortia, Molleriella, Molliardia, Mollisia, MoUisiaceae, Mollisiella, MoUisiopsis, Monacrosporium,* Monascaceae, *Monascostroma, Monascus, Monilia,* Moniliaceae, *Moniliales, Moniliopsis, Monilochaetes, Monoblastia,* Monoblepharidaceae, *Monoblephariopsis, Monoblepharis, Monochaetia, Monoecomyces, Monogrammia, Monographella, Monographus, Monopodium, Monopus, Monopycnis, Monorhiza, Monorhizina, Monospora, Monosporella, Monosporidium, Monosporiella, Monosporium, Monostichella, Monotospora, Monotrichum, Montagnellina, Montagnina, Montagnites, Montagnula, Montemartinia, Montoyella, Morchella, Morenella, Morenina, Morinia, Moriola, Moriolae, Mortierella, Mortierellae, Moschomyces, Moutoniella, Muchmoria, Muciporus, Mucor,* Mucoraceae, *Mucorae, Mucronella, Mucronoporus, Mucrosporium, Muellerella, Muiaria, Muiogone, Multipatina, Munkia, Munkiella, Munkiodothis, Murashkinskija, Mutinus, Mycaureola, Myceliophthora, Myceloderma, Mycelophagus, Mycena, Mycenastrum, Mycobacidia, Mycobacillaria, Mycobilimbia, Mycoblastus, Mycocalicium, Mycocitrus, Mycocladus, Mycodendrum, Mycoderma, Mycogala, Mycogone, Mycolangloisia, Mycolecidea, Mycolecis, Mycomalus, Mycophaga, Mycopharus,* Mycoporaceae, *Mycoporellum, Mycoporis, Mycoporum, Mycopyrcmila, Mycorhynchella, Mycorhynchus, Hi Mycosphaerella, MycosphaercUopsis, Mycosticta, Mycosyrinx, j\Uycotorula, Mycovellosiella, Myelosperma, Myiocoprella, Myiocoprum, Mylittopsis, Myriadoporus, Myriangella,* Myriangiaceae, *Myriangiae, Myriangina, Myrianginella, Myriangiopsis, Myriangium, Myridium, Myriellina, Myrillium, Myrioblepharis, Myriococcum, Myrioconium, Myrioconiuni, Myriogenis, Myriogenospora, Myriolecis, Myriophysa, Myriophysella, Myriopyxis, Alyriostigina, Myrmaeciella, Myrmaecium, Myrmecocystis, Myrotheciella, Myrothecium, Mystrosporium, Mytilidium, Myxasterina, Myxocyclus, Myxodictyum, Myxodiscus, Myxofusicoccum, Myxolibertella, Alyxomycidium, Myxomyriangis, Myxomyriangium, Myxonema, Myxophacidiella, Myxophacidiuni, Myxormia, Myxosporella, Myxosporina, Myxosporium, Myxotheca, Myxothecium, Myxothyrium, Myxotrichella, Myxotrichum, Myzocytium, Nadsonia, Naegelia,* Naeg-eliella, *Naemacyclus, Naematelia, Naemosphaera, Nacmosphaerella, Naemospora, Naetrocymbe, Naevia, Naeviella, Napicladium, Napomyces, Naucoria, Naumovia, Necator, Necium, Nectaromyccs, Nectria, Nectriella, Nectriella,* Nectrioidaceae, *Nectriopsis, Negeriella Nemastroma, Nematogonium, Nematospora, Nematosporangium, Nematostigma, Neinatostoma, Nematothecium, Nemozythiella, Neoarcangelia, Neobarclaya, Neobulgaria, Neocosmospora, Neofabraea, Neohendersonia, Neohenningsia, Neoheppia, Neohoehnelia, Neokeissleria, Neolamya, Neolecta, Neoniichclia, Neoncctria, Neopatella, Neopeckia, Neophoma, Neoplacosphaeria, Neoravenelia, Neorehmia, Neosaccardia, Neoskofitzia, Neosphaeropsis, Neostomella, Neotrichophytum, Neotrotteria, Neottiella, Neottiopezis, Neottiospora, Neottiosporella, Neottiosporis, Neovcnturia, Neovossia, Neozimmermannia, Nephlyctis, Nephroma, Nephromium, Nephromopsis, Nephrospora, Ncpotatiis, Nesolechia, Nidula, Nidularia,* Nidulariaceae, *Nielsenia, Niesslella, Niesslia, Nigropogon, Nigrosphaeria, Nigrospora,, Niorma, Niptera, Nitschkea. Nodulisphaeria, Nolanea, Nomuraea, Normandina, Norrlinia, Nostotheca, Notarisiella, Nothodiscus, Nothoravenelia, Nothospora, Nothostroma, Nowakowskia, Nowakowskiella, Nowellia, Nozcniia, Nummularia, Nyctalis, Nylanderiella, Nynianomyces, Nyssopsora, Nyssopsorella, Obelidium, Ocellaria, Ocellularia, Ochrolechia, Ochropsora, Octaviana, Odontia, Odontoschi/uin, Odontotrema, Odontotrcinella, Odontura, Oedemium, Oedocephalum, Oedomyces, Ohleria, Ohleriella, Oidiopsis, Oidium, Oleina, Oleinis, Oligostroina, Olivea, Ollula, Olpidiaceae, Olpidiae, Olpidiaster, Olpdiopsis, Olpidium, Olpitrichum, Ombrophila, Omphalia, Omphalospora, Oncopodium, Oncospora, Ontotelium, Onygena,* Onygenaceae, *Oomyces, Oospora, Oosporidca, Oothecium, Oothecium, Opeasterina, Opeasterinella, Opegrapha, Opethyrium, Ophiobolus, Ophiocapnis, Ophiocapnodium, Ophiocarpella, Ophioceras, Ophiochaeta, Ophiocladium, Ophiodictyum, Ophiodothella, Ophiodothis, Ophiogloea, Ophiognomonia, Ophiomassaria, Ophiomeliola, Ophionectria, Ophiopeltis, Ophiosphaerella, Ophiosphaeria, Ophiostoma, Ophiostomella, Ophiotexis, Ophiotrichum, Oplothecium, Oraniella, Orbicula, Orbilia, Orbiliopsis, Orcadia, Ordonia, Orinathoidium, Orphniospora, Oropogon, Orthoscypha, Oscarbrefeldia, Ostenfeldiella, Ostreionella, Ostreium, Ostropa, Ostropae, Oswaldia,*

TABLE D-continued

FUNGAL GENERA

*Oswaldina, Otidea, Otidella, Otthia, Otthiella, Oudemansiella, Ovularia, Oxydothis, Ozonium, Pachybasidiella, Pachybasium, Pachydiscula, Pachypatella, Pachyphiale, Pachyphloeus, Pachyrhytisma, Pachyspora, Pachytrichum, Pactilia, Paecilomyces, Paepalopsis, Paidania, Palawania, Palawaniella, Pampolysporium, Panaeolus, Pannaria, Pannariae, Panus, Papularia, Papulospora, Parabotryum, Paracapnodium, Paracesatiella, Paracudonia, Paracytospora, Paradidymella, Paradiplodia, Paralaestadia, Paramazzantia, Paranectria, Paranthostomella, Parapeltella, Parasclerophoma, Parasitella, Parasphaeria, Paraspora, Parasterina, Parastigmatea, Parathalle, Paratheliae, Parathelium, Parendomyces, Parenglerula, Parmelia,* Parmeliaceae, *Parmeliae, Parmeliella, Parmeliopsis, Parmentaria, Parmularia, Parmulariella, Parmulina,* Parmulineae, *Parodiella, Parodiellina, Parodiopsis, Paropsis, Paryphedria, Passalora, Passeriniella, Passerinula, Patellaria,* Patellariaceae, *Patellea, Patellina, Patellinae, Patellonectria, Patinella, Patouillardia, Patouillardiella, Patouillardina, Pauahia, Paulia, Paurocotylis, Paxillus, Paxina, Pazschkea, Pazschkella, Peccania, Peckia, Peckiella, Pedilospora, Pellicularia, Pellionella, Pelodiscus, Peloronectria, Peltaster, Peltella, Peltidea, Peltidium, Peltigera,* Peltigeraceae, *Peltigerae, Peltigeromyces, Peltistroma, Peltosoma, Peltosphaeria, Peltostroma, Peltostromella, Pemphidium, Penicilliopsis, Penicillium, Peniophora, Peniophorina, Penomyces, Pentagenella, Penzigia, Perforaria, Periaster, Peribotryuin, Perichlamys, Pericladium, Pericoccis, Periconia, Periconiella, Pericystis, Peridermium, Peridoxylum, Periola, Periolopsis, Perischizum,* Perisporiaceae, *Perisporiales, Ierisporiella, Perisporina, Perisporiopsis, Ierisporiopsis, Perisporium, Peristemma, Peristomium, Perizomatium, Perizomella, Peroneutypa, Peroneutypella, Peronoplasmopara, Peronospora,* Peronosporaceae, *Peronosporae, Perrotia, Perrotiella, Persooniella, Pertusaria, Pertusariae, Pestalozzia. Pestalozziella, Pestalozzina, Petasodes, Petelotia, Petractis, Petrakia, Petrakiella, Peyritschiella,* Peyritschiellaceae, *Peyronelia, Peziotrichum, Peziza,* Pezizaceae, *Pezizae, Pezizales, Pezizella, Pezizellaster, Z Pezolepis, Pezoloma, Pezomela, Phacenula,* Phacidiaceae, *Phacidiales, Phacidiella, Phacidina, Phacidiostroma, Phacidium, Phacopsis, Phacopsora, Phaeangella, Phaeangium, Phaeapiospora, Phaeaspis. Phaeharziella, Phaeidium, Phaeisaria, Phaeisariopsis, Phaeobotryosphaeria, Phaeobotryum, Phaeocapnodinula, Phaeochora, Phaeochorella, Phaeociboria, Ihaeoclavulina, Phaeoconis, Phaeocreopsis, Phaeocryptopus, Phaeocyphella, Phaeocytostroma, Phaeoderris, Phaeodiaporthe, Phaeodimeriella, Phaeodimeris, Phaeodiscula, Phaeodomus, Phaeodothiopsis, Phaeodothis, Phaeofabraea, Phaeoglossum, Phaeographina, Phaeographis, Phacoliygrocybe, Phaeolabrella, Phaeolimacium, Phaeomacropus, Phaeomarasniius, Phaeomarsonia, Phaeomarssonia, Phaeomeris, Ihaeoiiionostichella, Phaeopeltis, Phaeopeltis, Phaeopeltium, Phaeopeltosphaeria, Phaeopezia, Phaeophacidium, Phaeophleospora, Phaeophomatospora, Phaeophomopsis, Phaeopolynema, Phaeopterula, Phaeoradulum, Phaeorhytisma, Phaeosaccardinula, Phaeoschiffnerula, Phaeoscutella, Phaeoseptoria, Phaeosperma, Phaeosphaerella, Phaeosphaeria, Phaeospora, Phaeosporis, Phaeostigme, Phaeostigme, Phaeostilbella, Phaeothrombis, Phaeotrabutiella, Phaeotrema, Phaeotremella, Phaeotrype,* Phallaceae, *Phallobata, Phallogaster, Phallus, Phalodictyum, Phalostauris, Phalothrix, Phanerascus, Phanerococcus, Phanerocorynelia, Phanerocorynenm, Phaneroniyces, Phanosticta, Phanotylium, Pharcidia, Pharcidiella, Pharcidiopsis, Phellorina, Phellostroma, Phialea,* Phialophoi-a, *IMiillipsia, PhiUipsiella, Philocopra, Philonectria, Phlebia, Phlebophora, Phleboscyphus, Phlegmophiale, Phleogena, Phleospora, Phloeoconis, Phloeopeccania, Phlocophthora, Phlocosporella, Phlocosporina, Phlyctaena, Phlyctaeniella, Phlyctella, Phlyctidia, Phlyctidium, Phlyctis, Phlyctochytrium, riioenicostronia, Pholiota, Pholiotella, Phoma,* Phomaceae, *Phomachora, Phomales, Phomatospora, Phomatosporopsis, Phomopsina, Phomopsis, Phomyces, Phorcys, Phragmidiella, Phragmidium, Phragmocalosphaeria, Phragmocapnias, Phragmocarpella, Phraginocauma, Phragmodochium, Phragmodothella, Phragmodothidea, Phragmodothis, Phragmonaevia, Phragmopeltis, Phragmopyxine, Phragmopyxis, Phragmoscutella, Phragmosperma, Phragniotelium, Phragmothele, Phragmothyriella, Phragmothyrium, Phragmotrichum, Phthora, Phycascus, Phycodiscis, Phycomyces, Phycomycetes, Phycopsis, Phyllachora, Phyllachorae, Phyllachorella, Phyllactinia, Phylliscidium, Phylliscum, Phyllobathelium, Phylloblastia, Phyllobrassia, Phyllocarbon, Phyllocelis, Phyllocelis, Phyllocrea, Phylloedia, Phyllomyces, Phyllonochaeta, Phyllophthalmaria* Phylloporina*, Phylloporis, Phylloporthe, Phylloporus, Phyllopsora, Phyllopsorae, Phyllosticta, Phyllostictina, Phyllotremella, Phymatodiscus, Phymatosphaeria, Phymatotrichum, Physalacria, Physalospora, Physalosporella, Physalosporina, Physcia,* Physciaceae, *Physcidia, Physma, Physmatomyces, Physoderma, Physopella, Physospora, Physosporella, Phytophthora, Pichia, Picoa, Piersonia, Piggotia, Pila, Pilacre, Pilacrella, Pilaira, Pileolaria, Pilgeriella, Pilidiella, Pilidium, Piline, Pilobolae, Pilobolus, Pilocratera, Pilophorum, Pilosace, Pilula, Piniina, Pinoyella, Pionnotes, Piptocephalis, Piptostoma, Piptostomum, Pirella, Piricauda, Piricularia, Piringa, Pirobasidium, Pirogaster, Pirostoma, Pirostomella, Pirostomella, Pirottaea, Pisolithus, Pisomyxa, Pistillaria, Pithomyces, Pitya, Pityella, Placasterella, Placidiopsis, Placodiplodia, Placodothis, Placographa, Placonema, Placonemina, Placopeziza, Placophomopsis, Placosoma, Placosphaerella, Placosphaeria, Placostroma, Placothelium, Placothyrium, Plactogene, Ilacuntium, Placynthium, Plaiorhabdus, Plagiostigme, riagiostoma, Ilagiostomella, Magiostroniella, Ilagiotrema, Plasmodiophora,* Plasmodiophoraceae, *Plasmopara, Plasmophagus, liatycarpiuni, Platychora, Platygloea, riatypcltella, Ilatysticta, Platystomum, Plearthonis, Plectania, Plectodiscella, Plectonaemella, Plectopeltis, Plectophoma, Plectophomella, Plectophomopsis, Plectosira, Plectosphaera, Plectosphaerella, Plectospira, Plectothrix, Plenodomus, Plenophysa, Plenotrichum, Plenozythia, Pleochaeta, Pleochroma, Ileococcum, Pleoconis, Pleocouturea, Pieocyta, Pleodothis, Pleogibberella, Pleoglonis, Pleolecis, Pleolpidium, Pleomassaria, Pleomeliola, Pleomelogramma, Ileomeris, Pleomerium, Pleonectria, Pleopatella, Pleophalis, Pleophragiiiia, Pleopyrenis, Pleoravenelia, Pleorinis, Pleoscutula, Pleosphaeria, Pleosphaeropsis, Pleosphaeropsis, Pleosphaerulina, Pleospilis, Pleospora, Pleosporopsis, Pleostictis, Pleostomella, Pleotrachelus, Plcurage, Pleurascus, Pleuroceras, Pleurocolla, Pleurocybe, Pleurocytospora, Pleurodiscula, Pleuronaema, Pleurophoma, Pleurophomella, Pleurophomopsis, Pleuroplaconema, Pleuroplacosphaeria, Pleurostoma, Pleurostomella, Pieurothecium, Pleurotheliopsis, Pleurothyriella, Pleurothyrium, Pleurotrema, Pleurotus, Plicaria, PHcariella, Plochmopeltideila,* Plochmopeltineae, *Plochmopeltis, Ploettnera, Plowrightia, Plowrightiella, Iluriporus, Pluteolus, Pluteus, Pocillum, Pocosphaeria, Podaleuris, Podaxon, Podocapsa, Podocapsium, Podochytrium, Podocrea, Podonectria,*

TABLE D-continued

FUNGAL GENERA

*Podophacidium, Podoplaconema, Podosordaria, Podosphaera, Podospora, Podosporiella, Podosporium, Podostictina, Podostroma, Podostroma, Podoxyphium, Poecilosporium, Polhysterium, Polioma, Poliomella, Poliotelium, Polyascomyces, Polyblastia, Polyblastiopsis, Polycarpella, Polychaetella, Polychaetum, Polychaetum, Polychidium, Polyclypeolum, Polycoccum, Polycyclina, Polycyclus, Polydesmus, Polygaster, Polylagenochromatia, Polymorphomyccs, Polynema, Polyopeus, Polyphagus, Polyplocium,* Polyporaceae, *Polyporus, Iolyrhina, Polyrhizum, Polysaccopsis, Polysaccum, Polyscytalum, Polyspora, Polysporidium, Polystictus, Polystigma, Polystigmina, Polystomella,* Polystomellaceae, Polystomelleae, *Polystroma, Polythelis, Polythelis, Polythrincium, Polythyrium, Polytrichia, Pompholyx, Poria, Porina, Porinopsis, Porocyphus, Poronia, Poropeltis, Poroptyche, Porostigme, Porothelium, Porphyrosoma, Porterula, Pragmopara, Preussia, Prillieuxia, Prillieuxina, Pringsheimia, Prismaria, Pritzeliella, Proabsidia, Prolisea, Promycetes, Pronectria, Prophytroma, Propolidium, Propolina, Propoliopsis, Propolis, Prospodium, Prosthecium, Prosthemiella, Prosthemium, Protascus, Protasia, Proteomyces, Protoachlya, Protoblastenia, Protocalicium, Protococcales, Protocoronis, Protocoronospora, Protodontia, Protoglossum, Protohydnum, Protomerulius, Protomyces,* Protomycetaceae, *Protomycopsis, Protopeltis, Protoscypha, Protoscypha, Protostegia, Protothyrium, Protoventuria, Protubera, Psalidosperma, Psalliota, Psammina, Psathyra, Psathyrella, Pseudacolium, Pseuderiospora, Pseudoabsidia, Pseudobalsamia, Pseudobeltrania, Pseudocamptoum, Pseudocenangium, Pseudocercospora, Pseudocytospora, Pseudodiaporthe, Pseudodichomera, Pseudodictya, Pseudodimerium, Pseudodimeriujn, Pseudodiplodia, Pseudodiscosia, Pseudodiscula, Pseudofumago, Pseudogaster, Pseudogenea, Pseudographis, Pseudographium, Pseudoguignardia, Pseudohaplis, Pseudohaplosporella, Pseudohelotium, Pseudoheppia, Pseudohydnotrya, Pseudolachnea, Pseudolecanactis, Pseudolembosia, Pseudolizonia, Pseudolpidiopsis, Pseudolpidium, Pseudomassaria, Pseudombrophila, Pseiidomelasniia, Pseudomeliola, Pseudomicrocera, Pseudomonilia, Pseudomycoderma, Pseudonectria, Pseudoparmelia, Pseudoparodia, Pseudoparodiella, Pseudopatella, Pseudopatellina, Pseudoperis, Pseudoperisporium, Pseudoperonospora, Pseudopeziza, Pseudophacidium, Pseudophoma, Pseudophomopsis, Pseudophyllachora, Pseudophysalospora, Pseudopityella, Pseudoplasmopara, Pseudoplea, Pseudoplea, Pseudoplectania, Pseudopleospora, Pseudopolystigmina, Pseudopuccinia, Pseudopyrenula, Pseudorhynchia, Pseudorhytisma, Pseudosaccharomyces, Pseudosclerophoma, Pseudoseptoria, Pseudosphaerella, Pseudosphaeria, Pseudostegia, Pseudostictis, Pseudothiopsella, Pseudothis, Pseudothyridaria, Pseudotrochila, Pseudotryblidium, Pseudotrype, Pseudotthia, Pseudotthiella, Pseudovalsa, Pseudovularia, Pseudozythia, Psilocybe, Psiloglonium, Psilonia, Psilopezia, Psilospora, Psilosporina, Psilothecium, Psora, Psorella, Psoroglaena, Psorographis, Psoroma, Psoromaria, Psorotheciella, Psorotheciopsis, Psorotichia, Psyllidomyces, Pteridiospora, Pteromyces, Pterophyllus, Pterula, Pterygiopsis, Pterygium, Ptychographa, Ptychopeltis, Puccinia,* Pucciniaceae, *Pucciniales, Pucciniastrum, Pucciniopsis, Pucciniosira, Pucciniospora, Pucciniostele, Puiggariella, Puiggarina, Pullularia, Pulparia, Pulveraria, Punctillum, Pustularia, Puttemannsia, Puttemannsiella, Pycnidiella, Pycnidiostroma, Pycnis, Pycnocarpum, Pycnochytrium, Pycnoderma,. Pycnodothis, Pycnographa, Pycnomma, Pycnopeltis, Pycnosporium, Pycnostemma, Pycnostroma, Pycnostysanus, Pycnothyrium, Pyrertastrum, Pyrenidiae, Pyrenidium, Pyreniella, Pyrenobotrys, Pyrenochaeta, Pyrenochaetina, Pyrenocollema, Pyrenodiscus, Pyrenomyxa, Pyrenopezis, Pyrenopeziza, Pyrenopezizae, Pyrenopezizopsis, Pyrenophora, Pyrenopolyporus, Pyrenopsidae, Pyrenopsidium, Pyrenopsis, Pyrenostigme, Pyrenothamnia, Pyrenotheca, Pyrenothrix, Pyrenotrichum, Pyrenotrochila, Pyrenula, Pyrenulae, Pyrenyllium, Pyrgidium, Pyrgillus, Pyrhosorus, Pyronema, Pyronemella, Pythiae, Pythiocystis, Pythiogeton, Pythiomorpha, Pythiopsis, Pythium, Pyxidiophora, Pyxine, Quaternaria, Queletia, Questiera, Rabenhorstia, Rachisia, Raciborskiella, Kaciborskioiiiyces, Racodium, Radaisella, Radulum, Ramalina. Ramalodium, Ramonia, Ramosiella, Ramsbottomia, Ramularia, Ramulariopsis, Raniulariospora, Ramularisphaercllia, Ramulaspera, Rainulispora, Ranojevicia, Ravenelia, Ravenelula, Readerella, Rebentischia, Reessia, Rehniiella, Rehmiellopsis, Rehmiodothis, Rehmiomyces, Reinkella, "lC Resticularia, Reyesiella, Rhabdium, Rhabdocline, Rhabdogloeopsis, Rhabdogloeum, Rhabdopsora, Rhabdospora, Rhabdostroma, Rhabdostromella, Rhabdostromellina, Rhabdostromina, Rhabdothyrella, Rhabdothyrium, Rhachomyces, Rhacodiella, Rhacodium, Rhacophyllus, Rhadinomyces, Rhagadolobium, Rhagadostoma, Rhamphoria, Rhamphospora, Rhaphidisegestria, Rhaphidocyrtis, Rhaphidophora, Rhaphidopyris, Rhaphidospora, Rhaphidyllis, Rheumatopeltis, Rhinocladium, Rhinotrichum, Rhipidium, Rhipidocarpum, Rhizalia, Rhizidiocystis, Rhizidiomyces, Rhizidium, Rhizina, Rhizinae, Rhizocalyx, Rhizocarpum, Rhizoclosmatium, Rhizoctonia, Rhizogene, Rhizohypha, Rhizomorpha, Rhizomyces, Rhizomyxa, Rhizophidium, Rhizophlyctis, Rhizophoma, Rhizopogon, Rhizopus, Rhizosphaera, Rhizosphaerella, Rhizotexis, Rhizothyrium, Rhodobolites, Rhodochytrium, Rhodocybe, Rhodomyces, Rhodopaxillus, Rhodoseptoria, Rhodosticta, Rhodothrix, Rhodotorula, Rhodotus, Rhombostilbella, Rhopalidium, Rhopalocystis, Rhopalomyces, Rhopographella, Rhopographina, Rhopographus, Rhymbocarpus, Rhynchodiplodia, Rhynchomelas, Rhynchomeliola, Rhynchomyces, Rhynchomyces, Rhynchonectria, Rhynchophoma, Rhyncophoromyces, Rhynchophorus, Rhynchosphaeria, Rhynchosporium, Rhynchostoma, Rhynchostomopsis, Rhyparobius, Rhysotheca, Rhytidenglerula, Rhytidhysterium, Rhytidopeziza, Rhytisma, Rhytismella, Riccoa, Richonia, Rickia, Rickiella, Riessia, Rimbachia, Rinia, Rinodina, Robergea, Robertomyces, Robillardia, Robledia, Roccella, Roccellae, Roccellaria, Roccellina, Roccellographa, Rodwaya, Roesleria, Roestelia, Rollandina, Romellia, Rosellinia, Rosenscheldia, Rosenscheldiella, Rostkovites.* Rostrella, *Rostronitschkea, Rostrosphaeria, Rostrupia, Rotaea, Rotularia, Roumegueria, Roumegueriella, Roussoella, Rozella, Rozites, Ruhlandlella, Russula, Rutstroemia, Sabouraudites, Saccardaea, Saccardia, Saccardiae, Saccardinula, Saccardoella, Saccardomyces, Saccharomyces,* Saccharomycetaceae, *Saccharomycodes, Saccharomycopsis, Saccoblastia, Saccobolus, Saccomyces, Saccothecium, Sachsia, Sacidium, Sagediopsis, Sagiolechia, Saitomyces, Samarospora, Sampaioa, Santiella, Saprolegnia,* Saprolegniaceae, *Saprolegniae, Sapromyces, Sarcinella, Sarcinodochium, Sarcinomyces, Sarcographa, Sarcographina, Sarcomyces, Sarcophoma, Sarcopodium, Sarcopyrenia, Sarcoscypha, Sarcosphaera, Sarcosoma, Sarcotrochila, Sarcoxylum, Sarophorum, Sartorya, Scaphidium, Scelobelonium, Scenomyces, Sceptromyces, Schenckiella, Schiffnerula,* Schin/.ia, *Scliinzinia, Schismatomma, Schistodes, Schistophorum,*

TABLE D-continued

FUNGAL GENERA

*Schizachora, Schizacrospernnim, Schizocapnodium, Schizonella, Schizoparme, Schizopelte, Schizophyllum, Schizosaccharis, Schizosaccharomyces, Schizospora, Schizostege, Schizostoma, Schizothyrella, Schizothyrioma, Schizothyrium, Schizotrichum, Schizoxylum, Schneepia, Schoenbornia, Schroeterella, Schroeteria, Schroeteriaster, Schulzeria, Schwanniomyces, Schweinitziella, Sciodothis, Scirrhia, Scirrhiachora, Scirrhiella, Scirrhiopsis, Scirrhodothis, Scirrhophragma, Sclerangium, Sclerochaeta, Sclerochaetella, Sclerococcum, Sclerocystis, Sclerodcpsis, Scleroderma, Scleroderris, Sclerodiscus, Sclerodothiorella, Sclerodothis, Sclerographis, Sclerographium, Scleromeris, Sclerophoma, Sclerophomella, Sclerophomina, Sclerophytum, Scleroplea, Scleroplella, Scleropycnium, Sclerosphaeropsis, Sclerospora, Sclerostagonospora, Sclerotelium, Sclerotheca, Sclerothyrium, Sclerotinia, Sclerotiomyces, Sclerotiopsis, Sclerotium, Scodellina, Scolecactis, Scoleciocarpus, Scolecobasis, Scolecoccoidea, Scolecodothis, Scolecodothopsis, Scoleconectria, Scolecopeltidella, Scolecopeltidium, Scolecopeltis, Scolecopeltium, Scolecopeltopsis, Scolecosporiella, Scolecotrichum, Scolecozythia, Scoliciosporium, Scolionema, Scopinella, Scopophoma, Scoptria, Scopularia, Scopulariopsis, Scorias, Scoriomyces, Scortechinia, Scutellinia, Scutellum, Scutula, Scutularia, Scutellinia, Scutelliniae, Scyphospora, Scyphostroma, Scytopezis, Sebacina, Secotium, Seismosarca, Selenophoma, Selenophomopsis, Selenotila, Selinia, Semigyalecta, Sepedonium, Septobasidium, Septochora, Septocladia, Septocylindrium, Septocyta, Septocytella, Septodothideopsis, Septogloeum, Septoideum, Septomazzantia, Septomyxa, Septonema, Septopatella, Septorella, Septoria, Septoriella, Septoriopsis, Septorisphaerella, Septosporium, Septothyrella, Septotrullula, Sepultaria, Setchellia, Setella, Seuratia, Seynesia, Seynesiola, Seynesiopsis, Shearia, Shiraia, Shropshiria, Sigmatomyces, Sigmoidomyces, Sillia, Simblum, Simonyella, Siphonaria, Siphula, Sirentyloma, Sirexcipula, Sirexcipulina, Siridiella, Siridina, Siridium, Sirobasidium, Sirococcus, Sirocyphis, Sirodesmium, Sirodiplospora, Sirodochiella, Sirodothis, Sirogloea, Sirolegniella, Sirolpidium, Siropatella, Sirophoma, Siroplaconema, Siroplaconema, Siroscyphella, Siroscyphellina, Sirosperma, Sirosphaera, Sirospora, Sirosporium, Sirostromella, Sirothecium, Sirothyriella, Sirothyrium, Sirozythia, Sirozythiella, Sistotrema, Skepperia, Skepperiella, Skierkia, Skottsbergiella, Smeringomyces, Solanella, Solenia, Solenodonta, Solenoplea, Solenopsora, Solorina, Solorinella, Sommerstorffia, Sordaria, Sorica, Sorodiscus, Sorokinia, Sorolpidium, Sorosphaera, Sorosporium, Sorothelia, Sparassis, Spathularia, Spegazzinia, Spegazzinula, Spermatoloncha, Spennodennia, Spennophthora, Sphacelia, Sphaceliopsis, Sphacelotheca, Sphaerella, Sphaerellothecium,* Sphaeriaceae, *Sphaeriales, Sphaericeps, Sphaeridium, Sphaeriostromella, Sphaeriothyrium, Sphaerita, Sphaerobolus, Sphaerocista, Sphaerocolla, Sphaerocreas, Sphaeroderma, Sphaerodermella, Sphaerodes, Sphaerodothis, Sphaerognomonia, Sphaerographium, Sphaeromyces, Sphaeronema, Sphacronemella, Sphaeronemina, Sphaeronemopsis, Sphaeropezia, Sphaerophoma, Sphaerophoropsis, Sphaerophorus, Sphaerophragmium, Sphaeropsis, Sphaerosoma, Sphaerospora, Sphaerosporium, Sphaerostilbe, Sphaerostilbella, Sphaerotheca, Sphaerothyrium, Sphaerulina, Sphaleromyces, Spheconisca, Sphenospora, Sphinctrina, Sphinctrinopsis, Spicaria, Spicularia, Spilodochium, Spilomium, Spilomyces, Spilonema, Spilopezis, Spilopodia, Spilosticta, Spinalia, Spinellus, Spira, Spiralia, Spirechina, Spirogramma, Spirographa, Spirogyrales, Spirospora, Spolverinia, Spondylocladium, Spongospora, Sporendonema, Sporhelminthiuni, Sporobolomyces, Sporoclema, SporoctcJmorpha, Sporocybe, Sporocystis, Sporoderma, Sporodesmium, Sporodictyum, Sporodinia, Sporodiniopsis, Sporomega, Sporomyxa, Sporonema, Sporophlyctis, Sporophysa, Sporopodium, Sporormia, Sporormiella, Sporoschisma, Sporostachys, Sporotrichella, Sporotrichum, Spragueola, Spumatoria, Squamotubera, Stachybotryella, Stachybotrys, Stachylidium, Stagonopatella, Stagonopsis, Stagonospora, Stagonosporopsis, Stagonostroma, Stagonostromella, Staheliomyces, Stalagmites, Stamnaria, Starbaeckia, Starbaeckiella, Staurochaeta, Stauronema, Staurophoma, Staurothele, Steganopycnis, Steganosporium, Stegasphaeria, Stegastroma, Stegia, Stegopeziza, Stegopezizella, Stegophora, Stegothyrium, Steinera, Stella, Stemmaria, Stemphyliomma, Stemphyliopsis, Stemphyliopsis, Stemphylium, Stenocarpella, Stenocybe, Stephanoma, Stephanospora, Stephanotheca, Stephensia, Stereocaulum, Stereochlamys, Stereocrea, Stereolachnea, Stereostratum, Stereum, Sterigmatocystis, Sterile Mycelia, Stevensea, Stevensiella, Stevensula, Stichodothis, Stichomyces, Stichopsora, Stichospora, Sticta, Stictae,* Stictidaceae, *Stictina, Stictinae, Stictis, Stictochorella, Stictochorellina, Stictoclypeolum, Stictopatella, Stictophacidium, Stictostroma, Stigeosporium, Stigmatea,* Stigmateae, *Stigmatella, Stigmatodothis, Stigmatomyces, Stigmatopeltis, Stigmatophragmia, Stigmatopsis, Stigme, Stigmella, Stigmina, Stigmochora, Stigmopeltella, Zld Stigmopeltis, Stigmopsis,* Stilbaceae, *Stilbella, Stilbochalara, Stilbocrea, Stilbodendrum, Stilbohypoxylon, Stilbomyces, Stilbonectria, Stilbopeziza, Stilbospora, Stilbothamnium, Stilbum, Stirochaete, Stomatogene, Stomiopeltella, Stomiopeltis, Strasseria, Streptotheca, Streptothrix, Strickeria, Strigula, Strigulae, Strobilomyces, Stromatiiiia, Stromatographium, Stroinatostysanus, troninc, Strophuria, Strossmayera, Strumella, Strumellopsis, Stuartclla, Stylina, Stylobatcs, Stylonectria, Stypella, Stypinella, Stysanopsis, Stysanus, Subiilariella, Subulicola, Succinaria, Suilliis, Sydowia, Sydowiella, Sydowina, Sydowinula, Symphaeophyma, Symphaster, Symphyosira, Symplectromyces, Synalissa, Synarthonia, Syncarpella, Syncephalastrum, Syncephalidae, Syncephalis, Synchactophagus.* Synchytriaceae, *Synchytrium, Syncsiella, Synesiopeltis, Synglonium, Synnematium, Synomyces, Synostomella, Synpeltis, Synsporium, Syntexis, Synthctospora, Systremma, Systrcmmopsis, Syzygitcs, Taeniophora, Tang!ella, Tapellaria, Tapesia,. Taphridium, Taphrina, Tarichiuni, Tarzetta, Tassia, Teichospora, Teichosporella, Telcutospora, Telimena, Tcloconia, Tclospora, Tcphrosticta, reratomyces, Teratonema, Teratosperma, Teratosphaeria, Terfezia, Terfeziopsis, Termitaria, Testicularia, Testudina, Tetrachia, Tetrachytriuin, Tetracium, Tetracladium, Tetracoccosporis, Tetracoccosporium, Tetramyxa, Tetraploa, Thalassoascus, Tlialassomyces, Thallochaete, Thalloedema, Thamnidium, Thamnocephalis, Thamnolia, Thamnomyces, Thaxteria, Thaxteriella, Thecaphora, Theciopcltis, Thecopsora, Thecostroma, Thecotheus, Theissenia, Theissenula, Thelebolus, Thelenidia, Thelephora,* Thelephoraceae, *Thelidiopsis, Thelidium, Thelis, Thelocarpum, Theloporus, Thelopsis, Theloschistes, Thelospora, Thelotrema, Thermoidium, Thernioniyccs, Thermutis, Therrya, Thielavia, Thielaviopsis, Tholurna, Thoracella, Thozetia, Thrauste, Thraustotheca, Thrombium. Thuemenella, Thwaitesiella, Thyrea, Thyriascus, Thyridaria, Thyridella, Thyridium, Thyrinula, Thyriopsis, Thyriostoma, Thyriostroiiia, Thyrococciim, Thyrodochium, Thyronectria, Thyronectroidea, Thyrosoma,*

TABLE D-continued

FUNGAL GENERA

*Thyrospora, Thyrostroma, Thyrostromella, Thyrsidiella, Thyrsidina, Thyrsidium, Thysanopyxis, Thysanothecium, Tiarospora, Tiarosporella, Tichospora, Tichosporella, Ti Tichothecium, Tieeheniella, TilachlidioDsis.* Tilachlidium, Tilletia, Tilletiaceae, *Tilotus, Tirmania, Titaea, Titaeospora, Titaeosporina, Titanella, Titania, Tibodasia, Togninia, Tolypomyria, Tolyposporella, Tolyposporium, Tomasiella, Tomentellina, Tonduzia, Toninia, Topospora, Torrendia, Iorrcndiella, Torrubiella, Torsellia, Torula, Torula, Torulina, Toruloidea, Torulopsis, Torulospora, Toxosporium, Trabutiella, Trachysphaera, Trachyspora, Tracbysporella, Trachythyriolum, Trachyxylaria, Tracya, Tracyella, Trailia, Trailia, Trametes, Tranzschelia, Traversoa, Treleasia, Treleasiella, Trematophoma, Trematosphaerella, Trematosphaeria, Trematosphaeriopsis, Trematosphaeris, Treinatovalsa, Tremella,* Tremellaceae, *Tremellales, Tremellidium, Tremellodendrum, Tremellodon, Tremellogaster, Tremellopsis, Tremotylium, Treubiomyces, Triactella, Tricella, Trichaegum, Trichaleurina, Trichaleuris, Tricharia, Tricharia, Trichaster, Trichasterina, Trichobacidia, Trichobelonium, Trichobotrys, Trichochora, Trichococcinus, Trichocladium, Trichocollonema, Trichocoma, Trichoconis, Trichocrea, Trichoderma, Trichodiscula, Trichodochium, Trichodothis, Trichodytes, Trichofusarium, Trichoglossum, Trichohleria, Tricholoma, Trichomerium, Trichonectria,* Trichopelteae, *Trichopeltella, Trichopeltina, Trichopeltis, Trichopeltium, Trichopeltopsis, Trichopeltula, Trichopeltulum, Trichophila, Trichophyma, Trichophytum, Trichopsora, Trichoscypha, Trichoseptoria, Trichosperma, Trichospermella, Trichosphaerella, Trichosphaeria, Trichosporina, Trichosporium, Trichosterigma, Trichostronia, Trichothallus, Tricliotheca, Trichothecium, Trichothelium,* Trichothyriaceae, *Trichothyriella, Trichothyriopsis, Trichothyrium, Trichotrema, Trichurus, Tridens, Triglyphium, Trigonosporium, Trimmatostroma, Trimmatothele, Trinacrium, Triphragmiopsis, Triphragmium, Triplicaria, Tripospermum, Tripospora, Triposporina, Triposporium, Trochila, Trochodium, Trogia, Tromcra, Troposporella, Troposporium, i Trotteria, Trotterula, Trullula, Tryblidaria,* Tryblidiaceae, *Tryblidiella, Tryblidiopsis, Tryblidiopycnis, Tryblidis, Tryblidium, Tryblis, Trypetheliae, Trypethelium, Tubaria, Tuber,* Tuberaceae, *Tuberales, Tubercularia,* Tuberculariaceae, *Tiibercularielia, Tiiberculariopsis, Tubercularis, Tuberculina, Tuberculis, Tubeufia, Tuburcinia, Tulasnella, Tylophilus, Tylophorella, Tylophorum, Tylostoma, Tympanis, Tympanopsis, Typhula, Typhulochaeta, Tyridiomyces, U Ulcodolliella, Ulcodothis, Uleomyces, Uleopeltis, Uleothyrium, Ulocolla, Umbilicaria, Uncigera, Uncinula, Underwoodia, Unguicularia, Unguiculariopsis, Uredinopsis, Uredo, Urnula, Urobasidium, Uroconis, Urocystis, Lrohcndersonia, Uromyces, Uromycladium, Uromycopsis, Urophiala,. Urophlyctis, Uropolystigma, Uropyxis, Urospora, Urosporella, Urosporium, Usnea,* Usneae, Ustilaginaceae, *Ustilaginales, Ustilaginodes, Ustilago, Ustilagopsis, Ustulina, Valdensia, Valetoniella, Valsa, Valsaria, Valsella, Valseutypella, Valsonectria, Vanderystiella, Varicellaria, Varicosporium, Vasculomyces, Vaucheriales, yi Velloziella, Velutaria, Venturia, U Venturiella, Vermicularia, Vermicullariella, Verpa, Verrucaria,* Verrucariaceae, *Verrucariae, Verrucaster, Verticicladium, Verticilliae, Verticillidochium, Verticilliopsis, Verticillis, Verticillium, Vestergrenia, Vialaea, Vibrissea, Virgaria, Vittadinula, Vivianella, Vizella, Voeltzknowiella, Volkartia, Volutena, Volutellaria, Volutellis, Volutellopsis, Volutellops!s, Volutina, Volvaria, Volvariella, Volvoboletus, Vouauxiella, W Wageria, Wallrothiella, Wardina, Wardomyces, Wawelia, Wecsea, Wegelina, Weinmannodora, Wentiomyces, Wettsteinina, Wiesnerina, Wiesneriomyces, Willeya, Williopsis, Winterella, Winterina, Winteromyces, Wojnowicia, Wolkia, Woodiella, Woronina, Woroninae, Woroninella, Wynnea, Wynnella, Xanthocarpia, Xanthopsora, Xanthopyrenia, Xanthoria, Xenodochus, Xenodomus, Xenogloea, Xenolophium, Xenomeris, Xenomyces, Xenonectria, Xenopeltis, Xenopus, Xenosphaeria, Xenosporella, Xenosporium, Xenostele, Xenostroma, Xenothecium, Xerotus, Xiphomyces, Xylaria, Xylariodiscus, Xylobotryum, Xyloceras, Xylocladium, Xylocrea, Xyloglyphis, Xylogramma, Xylographa, Xyloma. Xylopodium, Xyloschistes, Xyloscbizuin, Xylostroma, Xystozukalia, Yatesula, Yoshinagaia, Yoshinagamyces, Yoshinagella, Ypsilonia, Zaghouania, Zahlbrucknerella, Zignoella, Zimmermanniella, Zodiomyces, Zonosporis, Zoophagus, Zopfia, Zopfiella, Zukalia, Zukalina, Zukaliopsis, Zukaliopsis, Zygochytrium, Zygodesmella, Zygodesmus, Zygorhizidium, Zygosaccharis, Zygosaccharomyces, Zygosporium, Zythia,* and Zythiaceae.

TABLE E

FUNGAL ENDOPHYTES

*Acidomyces acidophilus, Acremonium alternatum, Acremonium pteridii, Acremonium strictum, Acrodictys elaeidicola, Acrostalagmus luteoalbus, Albatrellus higanensis, Albonectria rigidiuscula, Alternaria alternata, Alternaria arborescens, Alternaria conjuncta, Alternaria helianthi, Alternaria longipes, Alternaria malorum, Alternaria metachromatica, Alternaria oregonensis, Alternaria photistica, Alternaria protenta, Alternaria tenuissima, Alternaria triticina, Alternaria zinniae, Amorphotheca resinae, Ampelomyces humuli, Anthostomella proteae, Apiognomonia errabunda, Aposphaeria populina, Arthrinium sacchari, Aspergillus aculeatus, Aspergillus niger, Aspergillus versicolor, Athelia bombacina, Aureobasidium pullulans, Bartalinia laurinia, Bartalinia pondoensis, Bartalinia robillardoides, Beauveria bassiana, Bionectria ochroleuca, Bipolaris papendorfii, Boeremia exigua* var. *exigua, Botryosphaeria rhodina, Botrytis cinerea, Brachysporium nigrum, Cadophora (Phialophora) finlandica, Camarosporium palliatum, Camarosporium propinquum, Candida tropicalis, Capnodium coffeae, Ceratobasidium cornigerum, Ceratobasidium obscurum, Cercophora terricola, Chaetomium globosum, Chaetomium sphaerale, Chaetosphaeria endophytica, Chaetosphaeria ovoidea, Chaunopycnis alba, Chaunopycnis pustulata, Chloridium phaeosporum, Chloridium preussii, Chromelosporium fulvum, Cladorrhinum bulbillosum, Cladosporium cladosporioides, Cladosporium edgeworthrae, Cladosporium herbarum, Cladosporium orchidis, Cladosporium oxysporum, Cladosporium tenuissimum, Clonostachys rosea, Clonostachys rosea f. catenulate, Cochliobolus australiensis, Cochliobolus geniculatus, Cochliobolus hawaiiensis, Cochliobolus lunatus, Cochliobolus tuberculatus, Colletotrichum acutatum, Colletotrichum capsici, Colletotrichum crassipes, Colletotrichum dematium, Colletotrichum gloeosporioides, Colletotrichum magna, Colletotrichum musae, Colletotrichum orbiculare, Colletotrichum truncatum, Coniella minima, Coniochaeta*

TABLE E-continued

FUNGAL ENDOPHYTES tetraspora, Coniochaeta velutina, Coniophora puteana, Coprinellus disseminates, Coprinellys radians, Cordyceps sinensis, Corynascus kuwaitiensis, Corynespora cassiicola, Crinipellis roreri, Cryphonectria parasitica, Cryptococcus victoriae, Curvularia affinis, Curvularia oryzae, Curvularia senegalensis, Curvularia sichuanensis, Cytosphaera mangiferae, Cytospora eucalypticola, Daldinia eschscholzi., Davidiella tassiana, Debaryomyces hansenii, Deightoniella torulosa, Diaporthe cynaroidis, Diaporthe eres, Diaporthe helianthi, Diaporthe phaseolorum, Dictyochaeta triseptata, Dothiorella aromatica, Dothiorella dominicana, Drechslera ellisii, Elsinoe veneta, Embellisia eureka, Emericella nidulans, Engyodontium album, Epicoccum nigrum, Epulorhiza anaticula, Epulorhiza repens, Eurotium amstelodami, Exserohilum rostratum, Fasciatispora petrakii, Fimetariella rabenhorstii, Fomes fomentarius, Fomes fomentarius, Fomitopsis ostreiformis, Fomitopsis pinicola, Fusarium anthophilum, Fusarium aquaeductuum, Fusarium avenaceum, Fusarium bulbicola, Fusarium chlamydosporum, Fusarium culmorum, Fusarium equiseti, Fusarium incarnatum, Fusarium lichenicola, Fusarium moniliforme, Fusarium oxysporum, Fusarium poae, Fusarium polyphialidicum, Fusarium proliferatum, Fusarium pulverosum, Fusarium semitectum var. majus, Fusarium solani, Fusarium sporotrichioides, Fusarium tricinctum, Fusarium verticillioides, Fusicladium britannicum, Ganoderma tsugae, Geomyces vinaceus, Gibberella avenacea, Gibberella baccata, Gibberella fujikuroi, Gibberella moniliformis, Gibberella zeae, Gliomastix murorum, Glomerella cingulata, Glomerella cingulate, Guignardi bidwelli, Guignardia camelliae, Guignardia citricarpa, Guignardia cocoicola, Guignardia mangiferae, Guignardia manqiferae, Guignardia vaccinii, Haematonectria haematococca, Haplotrichum minitissimum, Helgardia anguioides, Helminthosporium chlorophorae, Hypocrea virens, Hypoxylon fragiforme, Hypoxylon serpens, Hypoxylon stygium, Idriella amazonica, Idriella asaicola, Idriella euterpes, Idriella licualae, Ilyonectria radicicola, Kabatiella caulivora, Kluyveromyces marxianus, Kretzschmaria deusta, Lasiodiplodia pseudotheobromae, Lasiodiplodia theobromae, Laspora coronate, Leiosphaerella cocoes, Lentinus squarrosulus, Lepteutypa cupressi, Leptosphaeria coniothyrium, Leptosphaerulina trifolii, Letendraeopsis palmarum, Leucostoma niveum, Lewia eureka, Lewia eureka, Lunulospora curvula, Macrophomina phaseolina, Malbranchea circinata, Massarina arundinariae, Melanospora zamiae, Melanotus subcuneiformis, Melanotus subcuneiformis, Microascus cinereus, Minimidochium setosum, Moniliopsis anomala, Monodictys levis, Morchella elata, Mortierella alpine, Mucor fragilis, Mucor racemosus, Muscodor albus, Mycena murina, Mycocentrospora acerina, Myriangium duriaei, Nectria haematococca, Nemania aenea, Nemania bipapillata, Nemania serpens, Neofusicoccum mangiferae, Neotyphodium lolii, Neurospora crassa, Nigrospora oryzae, Nigrospora sphaerica, Nodulisporium anamorph of Hypoxylon fragiforme, Nodulisporium anamorph of Hypoxylon fuscum, Nodulisporium gregarium, Ochrocladosporium elatum, Ophiocordyceps sobolifera, Ophiostoma stenoceras, Oxydothis poliothea, Paecilomyces formosus, Papulosa amerospora, Paraconiothyrium minitans, Paraphaeosphaeria quadriseptata, Penicillium biourgeianum, Penicillium brevicompactum, Peniophora cinerea, Periconia anamorph of Didymosphaeria igniaria, Periconia digitata, Periconia hispidula, Periconia prolifica, Pestalotiopsis adusta, Pestalotiopsis caudata, Pestalotiopsis guepinii, Pestalotiopsis maculiformans, Pestalotiopsis microspora, Pestalotiopsis palmarum, Pestalotiopsis versicolor, Petriella sordida, Peziza varia, Peziza vesiculosa, Phaeangium lefebvrei, Phaedothis winteri, Phaeomoniella chlamydospora, Phaeotrichoconis crotalariae, Phanerochaete affinis, Phanerochaete sordida, Phialemonium dimorphosporum, Phlebia radiate, Phlogicylindrium eucalypti, Phoma glomerata, Phoma herbarum, Phoma leveillei, Phoma moricola, Phoma radicina, Phoma sorghina, Phoma subglomerata, Phoma tracheiphila, Phoma tropica, Phomatospora bellaminuta, Phomatospora berkeleyi, Phomopsis anacardii, Phomopsis casuarinae, Phomopsis leptostromiformis, Phomopsis mangiferae, Phomopsis manilkarae, Phomopsis orchidophila, Phyllosticta capitalensis, Phyllosticta colocasiicola, Phyllosticta minima, Phyllosticta sapotae, Piptarthron macrosporum, Piricauda pelagica, Piriformospora indica, Plagiostoma euphorbiae, Plenodomus fuscomaculans, Pleurophoma cava, Pleurotus ostreatus, Podospora fimbriata, Porosphaerella borinquensis, Preussia mediterranea, Preussia minima, Pseudocercospora punicae, Pseudocochliobolus pallescens, Pycnoporus cinnabarinus, Pycnoporus sanguineus, Pyriculariopsis parasitica, Ramichloridium apiculatum, Ramichloridium biverticillatum, Rhizopus stolonifer, Rhizopycnis vagum, Rhizosphaera kalkhoffii, Rhodotorula minuta, Schizophyllum commune, Scolecobasidium terreum, Scolicotrichum musae, Scopuloides hydnoides, Scytalidium lignicola, Sebacina vermifera, Septoria anacardii, Setosphaeria rostrata, Sordaria fimicola, Sordaria tomento-alba, Sporormiella minima, Stagonosporopsis dorenboschii, Stemphylium botryosum, Stemphylium solani, Stilbohypoxylon quisquiliarum var. quisquiliarum, Streptomyces albosporus, Streptomyces aureus, Streptomyces cinereus, Streptomyces glaucus, Streptomyces globisporus, Streptomyces griseofuscus, Streptomyces griseorubroviolaceus, Streptomyces hygroscopicus, Streptomyces roseosporus, Sydowia polyspora, Talaromyces flavus, Talaromyces ohiensis, Talaromyces ohiensis, Tetracladium furcatum, Thanatephorus cucumeris, Thanatephorus pennatus, Thermomyces lanuginosus, Thumenella cubispora, Torula herbarum f. quaternella, Trametes hirsuta, Trematosphaeria pertusa, Trichoderma hamatum, Trichoderma harzianum, Trichoderma koningii, Trichoderma longibrachiatum, Trichoderma viride, Trichothecium roseum, Triscelophorus acuminatus, Triscelophorus konajensis, Triscelophorus monosporus, Truncatella angustata, Truncatella conorum-piceae, Tulasnella calospora, Ulocladium atrum, Ulocladium cucurbitae, Ustilago williamsii, Valsa ceratosperma, Verruculina enalia, Verticillium lecanii, Wiesneriomyces laurinus, Wrightoporia tropicalis, Xylaria acuta, Xylaria adscendens, Xylaria allantoidea, Xylaria anisopleura, Xylaria arbuscula, Xylaria castorea Berk., Xylaria coccophora, Xylaria cubensis, Xylaria curia, Xylaria hypoxylon, Xylaria microceras, Xylaria multiplex, Xylaria obovata, Xylaria palmicola, Xylaria telfairii, Zalerion maritimum, Zygosporium echinosporum, and Zygosporium gibbum.

TABLE F

GROWTH MEDIA
Common media for the growth of microbes bacteria

| Microbe Type | Media | Organisms |
|---|---|---|
| Bacteria | Nutrient Peptone Agar | *Heterotrophic bacteria* |
| | MacConkey Agar + myo-inositol + Carbenicillin | *Klebsiella* Sp. |
| | J agar | *Bacillus* sp. and other firmicutes |
| | N-poor Medium (LGT) | Aerobic heterotrophic N2-fixing bacteria |
| | Yeast Mannitol Agar | *Rhizobium* sp. |
| | King's B medium | *Pseudomonas* sp. |
| | SC medium | Fastidious bacteria |
| | R2A agar | Oligotrophic bacteria |
| | Tryptic Soy Agar | Heterotrophic bacteria |
| Fungi | Cornmeal agar | Fungi |
| | Glucose-Yeast extract agar + tetracyclin | Selective enumeration of yeasts and moulds. |
| | Potato-Dextrose agar | Yeasts and molds |
| | Sabouraud Agar | Yeasts, molds and aciduric microorganisms |
| | V8 Agar | |
| | Malt Dextrose Agar | Identification of yeasts and moulds |
| | Czapek's medium | Fungi and Mold |
| | SPT agar | *Verticillium* sp. |

TABLE G

| Antibiotics | | | |
|---|---|---|---|
| Generic name | Brand names | Common uses | Mechanism of action |
| Aminoglycosides | | | |
| Amikacin | Amikin | Infections caused by Gram-negative bacteria, such as *Escherichia coli* and *Klebsiella* particularly *Pseudomonas aeruginosa*. Effective against Aerobic bacteria (not obligate/facultative anaerobes) and tularemia. | Binding to the bacterial 30S ribosomal subunit (some work by binding to the 50S subunit), inhibiting the translocation of the peptidyl-tRNA from the A-site to the P-site and also causing misreading of mRNA, leaving the bacterium unable to synthesize proteins vital to its growth. |
| Gentamicin | Garamycin | | |
| Kanamycin | Kantrex | | |
| Neomycin | Neo-Fradin[3] | | |
| Netilmicin | Netromycin | | |
| Tobramycin | Nebcin | | |
| Paromomycin | Humatin | | |
| Spectinomycin | Trobicin | Gonorrhea | |
| Ansamycins | | | |
| Geldanamycin | | Experimental, as antitumor antibiotics | |
| Herbimycin | | | |
| Rifaximin, streptomycin | Xifaxan | Travelers diarrhea caused by *E. coli* | |
| Carbacephem | | | |
| Loracarbef | Lorabid | Discontinued | prevents bacterial cell division by inhibiting cell wall synthesis. |
| Carbapenems | | | |
| Ertapenem | Invanz | Bactericidal for both Gram-positive and Gram-negative organisms and therefore useful for empiric broad-spectrum antibacterial coverage. (Note MRSA resistance to this class.) | Inhibition of cell wall synthesis |
| Doripenem | Doribax | | |
| Imipenem/Cilastatin | Primaxin | | |
| Meropenem | Merrem | | |
| Cephalosporins (First generation) | | | |
| Cefadroxil | Duricef | Good coverage against Gram-positive infections. | Same mode of action as other beta-lactam antibiotics: disrupt the synthesis of the peptidoglycan layer of bacterial cell walls. |
| Cefazolin | Ancef | | |
| Cefalotin or Cefalothin | Keflin | | |
| Cefalexin | Keflex | | |
| Cephalosporins (Second generation) | | | |
| Cefaclor | Distaclor | Less Gram-positive cover, improved Gram-negative cover. | Same mode of action as other beta-lactam antibiotics: disrupt the synthesis of the peptidoglycan layer of bacterial cell walls. |
| Cefamandole | Mandol | | |
| Cefoxitin | Mefoxin | | |
| Cefprozil | Cefzil | | |
| Cefuroxime | Ceftin, Zinnat (UK) | | |
| Cephalosporins (Third generation) | | | |
| Cefixime | Suprax | Improved coverage of Gram-negative organisms, except Pseudomonas. Reduced Gram-positive cover. | Same mode of action as other beta-lactam antibiotics: disrupt the synthesis of the peptidoglycan layer of bacterial cell walls. |
| Cefdinir | Omnicef, Cefdiel | | |
| Cefditoren | Spectracef | | |
| Cefoperazone | Cefobid | | |
| Cefotaxime | Claforan | | |
| Cefpodoxime | Vantin | | |

TABLE G-continued

Antibiotics

| Generic name | Brand names | Common uses | Mechanism of action |
|---|---|---|---|
| Ceftazidime | Fortaz | | |
| Ceftibuten | Cedax | | |
| Ceftizoxime | Cefizox | | |
| Ceftriaxone | Rocephin | | |
| | | Cephalosporins (Fourth generation) | |
| Cefepime | Maxipime | Covers pseudomonal infections. | Same mode of action as other beta-lactam antibiotics: disrupt the synthesis of the peptidoglycan layer of bacterial cell walls. |
| | | Cephalosporins (Fifth generation) | |
| Ceftaroline fosamil | Teflaro | Used to treat MRSA | Same mode of action as other beta-lactam antibiotics: disrupt the synthesis of the peptidoglycan layer of bacterial cell walls. |
| Ceftobiprole | Zeftera | Used to treat MRSA | Same mode of action as other beta-lactam antibiotics: disrupt the synthesis of the peptidoglycan layer of bacterial cell walls. |
| | | Glycopeptides | |
| Teicoplanin | Targocid (UK) | Active against aerobic and anaerobic Gram-positive bacteria including MRSA; Vancomycin is used orally for the treatment of *C. difficile* | inhibiting peptidoglycan synthesis |
| Vancomycin | Vancocin | | |
| Telavancin | Vibativ | | |
| | | Lincosamides | |
| Clindamycin | Cleocin | Serious staph-, pneumo-, and streptococcal infections in penicillin-allergic patients, also anaerobic infections; clindamycin topically for acne | Bind to 50S subunit of bacterial ribosomal RNA thereby inhibiting protein synthesis |
| Lincomycin | Lincocin | | |
| | | Lipopeptide | |
| Daptomycin | Cubicin | Gram-positive organisms | Bind to the membrane and cause rapid depolarization, resulting in a loss of membrane potential leading to inhibition of protein, DNA and RNA synthesis |
| | | Macrolides | |
| Azithromycin | Zithromax, Sumamed, Xithrone | Streptococcal infections, syphilis, upper respiratory tract infections, lower respiratory tract infections, mycoplasmal infections, Lyme disease | inhibition of bacterial protein biosynthesis by binding reversibly to the subunit 50S of the bacterial ribosome, thereby inhibiting translocation of peptidyl tRNA. |
| Clarithromycin | Biaxin | | |
| Dirithromycin | Dynabac | | |
| Erythromycin | Erythocin, Erythroped | | |
| Roxithromycin | | | |
| Troleandomycin | Tao | | |
| Telithromycin | Ketek | Pneumonia | |
| Spiramycin | Rovamycine | Mouth infections | |
| | | Monobactams | |
| Aztreonam | Azactam | | Same mode of action as other beta-lactam antibiotics: disrupt the synthesis of the peptidoglycan layer of bacterial cell walls. |
| | | Nitrofurans | |
| Furazolidone | Furoxone | Bacterial or protozoal diarrhea or enteritis | |
| Nitrofurantoin | Macrodantin, Macrobid | Urinary tract infections | |
| | | Oxazolidonones | |
| Linezolid | Zyvox | VRSA | Protein synthesis inhibitor; prevents the initiation step |
| Posizolid | Phase II clinical trials | | |
| Radezolid | Phase II clinical trials | | |
| Torezolid | Phase II clinical trials | | |

TABLE G-continued

Antibiotics

| Generic name | Brand names | Common uses | Mechanism of action |
|---|---|---|---|
| Penicillins | | | |
| Amoxicillin | Novamox, Amoxil | Wide range of infections; penicillin used for streptococcal infections, syphilis, and Lyme disease | Same mode of action as other beta-lactam antibiotics: disrupt the synthesis of the peptidoglycan layer of bacterial cell walls. |
| Ampicillin | Principen | | |
| Azlocillin | | | |
| Carbenicillin | Geocillin | | |
| Cloxacillin | Tegopen | | |
| Dicloxacillin | Dynapen | | |
| Flucloxacillin | Floxapen (Sold to European generics Actavis Group) | | |
| Mezlocillin | Mezlin | | |
| Methicillin | Staphcillin | | |
| Nafcillin | Unipen | | |
| Oxacillin | Prostaphlin | | |
| Penicillin G | Pentids | | |
| Penicillin V | Veetids (Pen-Vee-K) | | |
| Piperacillin | Pipracil | | |
| Penicillin G | Pfizerpen | | |
| Temocillin | Negaban (UK) | | |
| Ticarcillin | Ticar | | |
| Penicillin combinations | | | |
| Amoxicillin/clavulanate | Augmentin | | The second component prevents bacterial resistance to the first component |
| Ampicillin/sulbactam | Unasyn | | |
| Piperacillin/tazobactam | Zosyn | | |
| Ticarcillin/clavulanate | Timentin | | |
| Polypeptides | | | |
| Bacitracin | | Eye, ear or bladder infections; usually applied directly to the eye or inhaled into the lungs; rarely given by injection, although the use of intravenous colistin is experiencing a resurgence due to the emergence of multi drug resistant organisms. | Inhibits isoprenyl pyrophosphate, a molecule that carries the building blocks of the peptidoglycan bacterial cell wall outside of the inner membrane[5] |
| Colistin | Coly-Mycin-S | | Interact with the Gram-negative bacterial outer membrane and cytoplasmic membrane. It displaces bacterial counter ions, which destabilizes the outer membrane. They act like a detergent against the cytoplasmic membrane, which alters its permeability. Polymyxin B and E are bactericidal even in an isosmotic solution. |
| Polymyxin B | | | |
| Quinolones | | | |
| Ciprofloxacin | Cipro, Ciproxin, Ciprobay | Urinary tract infections, bacterial prostatitis, community-acquired pneumonia, bacterial diarrhea, mycoplasmal infections, gonorrhea | inhibit the bacterial DNA gyrase or the topoisomerase IV enzyme, thereby inhibiting DNA replication and transcription. |
| Enoxacin | Penetrex | | |
| Gatifloxacin | Tequin | | |
| Levofloxacin | Levaquin | | |
| Lomefloxacin | Maxaquin | | |
| Moxifloxacin | Avelox | | |
| Nalidixic acid | NegGram | | |
| Norfloxacin | Noroxin | | |
| Ofloxacin | Floxin, Ocuflox | | |
| Trovafloxacin | Trovan | Withdrawn | |
| Grepafloxacin | Raxar | Withdrawn | |
| Sparfloxacin | Zagam | Withdrawn | |
| Temafloxacin | Omniflox | Withdrawn | |
| Sulfonamides | | | |
| Mafenide | Sulfamylon | Urinary tract infections (except sulfacetamide, used for eye infections, and mafenide and silver sulfadiazine, used topically for burns) | Folate synthesis inhibition. They are competitive inhibitors of the enzyme dihydropteroate synthetase, DHPS. DHPS catalyses the conversion of PABA (para-aminobenzoate) to dihydropteroate, a key step in folate synthesis. Folate is necessary for the cell to synthesize nucleic acids (nucleic acids are essential building blocks of DNA and RNA), and in its absence cells cannot divide. |
| Sulfacetamide | Sulamyd, Bleph-10 | | |
| Sulfadiazine | Micro-Sulfon | | |
| Silver sulfadiazine | Silvadene | | |
| Sulfadimethoxine | Di-Methox, Albon | | |
| Sulfamethizole | Thiosulfil Forte | | |
| Sulfamethoxazole | Gantanol | | |
| Sulfanilimide (archaic) | | | |
| Sulfasalazine | Azulfidine | | |

TABLE G-continued

| | Antibiotics | | |
|---|---|---|---|
| Generic name | Brand names | Common uses | Mechanism of action |
| Sulfisoxazole | Gantrisin | | |
| Trimethoprim-Sulfamethoxazole (Co-trimoxazole) (TMP-SMX) | Bactrim, Septra | | |
| Sulfonamidochrysoidine (archaic) | Prontosil | | |
| | | Tetracyclines | |
| Demeclocycline | Declomycin | Syphilis, chlamydial | inhibiting the binding of aminoacyl- |
| Doxycycline | Vibramycin | infections, Lyme disease, | tRNA to the mRNA-ribosome complex. |
| Minocycline | Minocin | mycoplasmal infections, | They do so mainly by binding to the 30S |
| Oxytetracycline | Terramycin | acne rickettsial infections, | ribosomal subunit in the mRNA |
| Tetracycline | Sumycin, Achromycin V, Steclin | *malaria * Note: Malaria is caused by a protist and not a bacterium. | translation complex. |
| | | Drugs against mycobacteria | |
| Clofazimine | Lamprene | Antileprotic | |
| Dapsone | Avlosulfon | Antileprotic | |
| Capreomycin | Capastat | Antituberculosis | |
| Cycloserine | Seromycin | Antituberculosis, urinary tract infections | |
| Ethambutol | Myambutol | Antituberculosis | |
| Ethionamide | Trecator | Antituberculosis | Inhibits peptide synthesis |
| Isoniazid | I.N.H. | Antituberculosis | |
| Pyrazinamide | Aldinamide | Antituberculosis | |
| Rifampicin (Rifampin in US) | Rifadin, Rimactane | mostly Gram-positive and mycobacteria | Binds to the β subunit of RNA polymerase to inhibit transcription |
| Rifabutin | Mycobutin | Mycobacterium avium complex | |
| Rifapentine | Priftin | Antituberculosis | |
| Streptomycin | | Antituberculosis | As other aminoglycosides |
| | | Others | |
| Arsphenamine | Salvarsan | Spirochaetal infections (obsolete) | |
| Chloramphenicol | Chloromycetin | meningitis, MRSA, topical use, or for low cost internal treatment. Historic: typhus, cholera. Gram-negative, Gram-positive, anaerobes | Inhibits bacterial protein synthesis by binding to the 50S subunit of the ribosome |
| Fosfomycin | Monurol | Acute cystitis in women | Inactivates enolpyruvyl transferase, thereby blocking cell wall synthesis |
| Fusidic acid | Fucidin | | |
| Metronidazole | Flagyl | Infections caused by anaerobic bacteria; also amoebiasis, trichomoniasis, Giardiasis | Produces toxic free radicals that disrupt DNA and proteins. This non-specific mechanism is responsible for its activity against a variety of bacteria, amoebae, and protozoa. |
| Mupirocin | Bactroban | Ointment for impetigo, cream for infected cuts | Inhibits isoleucine t-RNA synthetase (IleRS) causing inhibition of protein synthesis |
| Platensimycin | | | |
| Quinupristin/Dalfopristin | Synercid | | |
| Thiamphenicol | | Gram-negative, Gram-positive, anaerobes. widely used in veterinary medicine. | A chloramphenicol analog. May inhibit bacterial protein synthesis by binding to the 50S subunit of the ribosome |
| Tigecycline | Tigacyl | Indicated for complicated skin/skin structure infections and complicated intra-abdominal infections. ||Teeth discoloration.|| | |
| Tinidazole | Tindamax Fasigyn | protozoan infections | |
| Trimethoprim | Proloprim, Trimpex | Urinary Tract Infections | |

TABLE H

TRANSGENIC PLANTS

| Crop | Event | Company | Description | Patent |
|---|---|---|---|---|
| Potato | ATBT04-6, ATBT04-27, ATBT04-30, ATBT04-31, ATBT04-36, SPBT02-5, SPBT02-7 | Monsanto Company | Colorado potato beetle resistant potatoes produced by inserting the cry3A gene from Bacillus thuringiensis (subsp. Tenebrionis). | |
| Potato | BT6, BT10, BT12, BT16, BT17, BT18, BT23 | Monsanto Company | Colorado potato beetle resistant potatoes produced by inserting the cry3A gene from Bacillus thuringiensis (subsp. Tenebrionis). | |
| Potato | EH92-527-1 | BASF Plant Science | Altered starch composition, increased amylopectin to amylose ratio, through the introduction of a fragment of the potato granule-bound starch synthase encoding gene (gbss) in the anti-sense orientation. The nptIIgene was also introduced as a selectable marker for identifying transformed plants. | |
| Potato | RBMT15-101, SEMT15-02, SEMT15-15 | Monsanto Company | Colorado potato beetle and potato virus Y (PVY) resistant potatoes produced by inserting the cry3A gene from Bacillus thuringiensis (subsp. Tenebrionis) and the coat protein encoding gene from PVY. | |
| Potato | RBMT21-129, RBMT21-350, RBMT22-082 | Monsanto Company | Colorado potato beetle and potato leafroll virus (PLRV) resistant potatoes produced by inserting the cry3A gene from Bacillus thuringiensis (subsp. Tenebrionis) and the replicase encoding gene from PLRV. | |
| Rice | CL121, CL141, CFX51 | BASF Inc. | Tolerance to the imidazolinone herbicide, imazethapyr, induced by chemical mutagenesis of the acetolactate synthase (ALS) enzyme using ethyl methanesulfonate (EMS). | |
| Rice | IMINTA-1, IMINTA-4 | BASF Inc. | Tolerance to imidazolinone herbicides induced by chemical mutagenesis of the acetolactate synthase (ALS) enzyme using sodium azide. | US 20070028318 A1 |
| Rice | LLRICE06, LLRICE62 | Aventis CropScience | Glufosinate ammonium herbicide tolerant rice produced by inserting a modified phosphinothricin acetyltransferase (PAT) encoding gene from the soil bacterium Streptomyces hygroscopicus). | WO 2001083818 A2 |
| Rice | LLRICE601 | Bayer CropScience (Aventis CropScience (AgrEvo)) | Glufosinate ammonium herbicide tolerant rice produced by inserting a modified phosphinothricin acetyltransferase (PAT) encoding gene from the soil bacterium Streptomyces hygroscopicus). | US 20080289060 A1 |
| Rice | PWC16 | BASF Inc. | Tolerance to the imidazolinone herbicide, imazethapyr, induced by chemical mutagenesis of the acetolactate synthase (ALS) enzyme using ethyl methanesulfonate (EMS). | |
| Soybean | A2704-12, A2704-21, A5547-35 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium Streptomyces viridochromogenes. | |
| Soybean | A5547-127 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium Streptomyces viridochromogenes. | |

TABLE H-continued

TRANSGENIC PLANTS

| Crop | Event | Company | Description | Patent |
|---|---|---|---|---|
| Soybean | BPS-CV127-9 | BASF Inc. | The introduced csr1-2 gene from *Arabidopsis thaliana* encodes an acetohydroxyacid synthase protein that confers tolerance to imidazolinone herbicides due to a point mutation that results in a single amino acid substitution in which the serine residue at position 653 is replaced by asparagine (S653N). | |
| Soybean | DP-305423 | DuPont Pioneer | High oleic acid soybean produced by inserting additional copies of a portion of the omega-6 desaturase encoding gene, gm-fad2-1resulting in silencing of the endogenous omega-6 desaturase gene (FAD2-1). | |
| Soybean | DP356043 | DuPont Pioneer | Soybean event with two herbicide tolerance genes: glyphosate N-acetyltransferase, which detoxifies glyphosate, and a modified acetolactate synthase (ALS) gene which is tolerant to ALS-inhibitng herbicides. | |
| Soybean | G94-1, G94-19, G168 | DuPont Canada Agricultural Products | High oleic acid soybean produced by inserting a second copy of the fatty acid desaturase (GmFad2-1) encoding gene from soybean, which resulted in "silencing" of the endogenous host gene. | |
| Soybean | GTS 40-3-2 | Monsanto Company | Glyphosate tolerant soybean variety produced by inserting a modified 5-enolpyruvylshikimate-3-phosphate synthase (EPSPS) encoding gene from the soil bacterium *Agrobacterium tumefaciens*. | |
| Soybean | GU262 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. | |
| Soybean | MON87701 | Monsanto Company | Resistance to lepidopteran pests of soybean including velvetbean caterpillar (*Anticarsia gemmatalis*) and soybean looper (*Pseudoplusia includens*). | |
| Soybean | MON87701 × MON89788 | Monsanto Company | Glyphosate herbicide tolerance through expression of the EPSPS encoding gene from *A. tumefaciens* strain CP4, and resistance to lepidopteran pests of soybean including velvetbean caterpillar (*Anticarsia gemmatalis*) and soybean looper (*Pseudoplusia includens*) via expression of the Cry1Ac encoding gene from *B. thuringiensis*. | U.S. Pat. No. 8,455,198 B2 |
| Soybean | MON89788 | Monsanto Company | Glyphosate-tolerant soybean produced by inserting a modified 5-enolpyruvylshikimate-3-phosphate synthase (EPSPS) encoding aroA (epsps) gene from *Agrobacterium tumefaciens* CP4. | |
| Soybean | OT96-15 | Agriculture & Agri-Food Canada | Low linolenic acid soybean produced through traditional cross-breeding to incorporate the novel trait from a naturally occurring fan1 gene mutant that was selected for low linolenic acid. | U.S. Pat. No. 7,632,985 B2 |
| Soybean | W62, W98 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces hygroscopicus*. | |

TABLE H-continued

TRANSGENIC PLANTS

| Crop | Event | Company | Description | Patent |
|------|-------|---------|-------------|--------|
| Squash | CZW-3 | Asgrow (USA); Seminis Vegetable Inc. (Canada) | Cucumber mosiac virus (CMV), zucchini yellows mosaic (ZYMV) and watermelon mosaic virus (WMV) 2 resistant squash (*Curcurbita pepo*) produced by inserting the coat protein (CP) encoding sequences from each of these plant viruses into the host genome. | U.S. Pat. No. 6,337,431 B1 |
| Squash | ZW20 | Upjohn (USA); Seminis Vegetable Inc. (Canada) | Zucchini yellows mosaic (ZYMV) and watermelon mosaic virus (WMV) 2 resistant squash (*Curcurbita pepo*) produced by inserting the coat protein (CP) encoding sequences from each of these plant poty viruses into the host genome. | U.S. Pat. No. 6,337,431 B1 |
| Beet | GTSB77 | Novartis Seeds; Monsanto Company | Glyphosate herbicide tolerant sugar beet produced by inserting a gene encoding the enzyme 5-enolypyruvylshikimate-3-phosphate synthase (EPSPS) from the CP4 strain of *Agrobacterium tumefaciens*. | |
| Beet | H7-1 | Monsanto Company | Glyphosate herbicide tolerant sugar beet produced by inserting a gene encoding the enzyme 5-enolypyruvylshikimate-3-phosphate synthase (EPSPS) from the CP4 strain of *Agrobacterium tumefaciens*. | U.S. Pat. No. 7,335,816 B2 |
| Beet | T120-7 | Bayer CropScience (Aventis CropScience (AgrEvo)) | Introduction of the PPT-acetyltransferase (PAT) encoding gene from *Streptomyces viridochromogenes*, an aerobic soil bacteria. PPT normally acts to inhibit glutamine synthetase, causing a fatal accumulation of ammonia. Acetylated PPT is inactive. | |
| Tobacco | C/F/93/08-02 | Societe National dExploitation des Tabacs et Allumettes | Tolerance to the herbicides bromoxynil and ioxynil by incorporation of the nitrilase gene from *Klebsiella pneumoniae*. | |
| Tobacco | Vector 21-41 | Vector Tobacco Inc. | Reduced nicotine content through introduction of a second copy of the tobacco quinolinic acid phosphoribosyltransferase (QTPase) in the antisense orientation. The NPTII encoding gene from *E. coli* was introduced as a selectable marker to identify transformants. | US 20050072047 A1 |
| Wheat | AP205CL | BASF Inc. | Selection for a mutagenized version of the enzyme acetohydroxyacid synthase (AHAS), also known as acetolactate synthase (ALS) or acetolactate pyruvate-lyase. | |
| Wheat | AP602CL | BASF Inc. | Selection for a mutagenized version of the enzyme acetohydroxyacid synthase (AHAS), also known as acetolactate synthase (ALS) or acetolactate pyruvate-lyase. | |
| Wheat | BW255-2, BW238-3 | BASF Inc. | Selection for a mutagenized version of the enzyme acetohydroxyacid synthase (AHAS), also known as acetolactate synthase (ALS) or acetolactate pyruvate-lyase. | |
| Wheat | BW7 | BASF Inc. | Tolerance to imidazolinone herbicides induced by chemical mutagenesis of the acetohydroxyacid synthase (AHAS) gene using sodium azide. | |
| Wheat | MON71800 | Monsanto Company | Glyphosate tolerant wheat variety produced by inserting a modified 5-enolpyruvylshikimate-3-phosphate synthase (EPSPS) encoding gene | U.S. Pat. No. 6,689,880 |

TABLE H-continued

TRANSGENIC PLANTS

| Crop | Event | Company | Description | Patent |
|---|---|---|---|---|
| Wheat | SWP965001 | Cyanamid Crop Protection | from the soil bacterium *Agrobacterium tumefaciens*, strain CP4. Selection for a mutagenized version of the enzyme acetohydroxyacid synthase (AHAS), also known as acetolactate synthase (ALS) or acetolactate pyruvate-lyase. | |
| Wheat | Teal 11A | BASF Inc. | Selection for a mutagenized version of the enzyme acetohydroxyacid synthase (AHAS), also known as acetolactate synthase (ALS) or acetolactate pyruvate-lyase. | |

TABLE I

Fungicides commonly used in agriculture 2-(thiocyanatomethylthio)-benzothiazole, 2-phenylphenol, 8-hydroxyquinoline sulfate, ametoctradin, amisulbrom, antimycin, Ampelomyces quisqualis, azaconazole, azoxystrobin, *Bacillus subtilis*, benalaxyl, benomyl, benthiavalicarb-isopropyl, benzylaminobenzene-sulfonate (BABS) salt, bicarbonates, biphenyl, bismerthiazol, bitertanol, bixafen, blasticidin-S, borax, Bordeaux mixture, boscalid, bromuconazole, bupirimate, calcium polysulfide, captafol, captan, carbendazim, carboxin, carpropamid, carvone, chloroneb, chlorothalonil, chlozolinate, *Coniothyrium minitans*, copper hydroxide, copper octanoate, copper oxychloride, copper sulfate, copper sulfate (tribasic), cuprous oxide, cyazofamid, cyflufenamid, cymoxanil, cyproconazole, cyprodinil, dazomet, debacarb, diammonium ethylenebis-(dithiocarbamate), dichlofluanid, dichlorophen, diclocymet, diclomezine, dichloran, diethofencarb, difenoconazole, difenzoquat ion, diflumetorim, dimethomorph, dimoxystrobin, diniconazole, diniconazole-M, dinobuton, dinocap, diphenylamine, dithianon, dodemorph, dodemorph acetate, dodine, dodine free base, edifenphos, enestrobin, epoxiconazole, ethaboxam, ethoxyquin, etridiazole, famoxadone, fenamidone, fenarimol, fenbuconazole, fenfuram, fenhexamid, fenoxanil, fenpiclonil, fenpropidin, fenpropimorph, fentin, fentin acetate, fentin hydroxide, ferbam, ferimzone, fluazinam, fludioxonil, flumorph, fluopicolide, fluopyram, fluoroimide, fluoxastrobin, fluquinconazole, flusilazole, flusulfamide, flutianil, flutolanil, flutriafol, fluxapyroxad, folpet, formaldehyde, fosetyl, fosetyl-aluminium, fuberidazole, furalaxyl, furametpyr, guazatine, guazatine acetates, GY-81, hexachlorobenzene, hexaconazole, hymexazol, imazalil, imazalil sulfate, imibenconazole, iminoctadine, iminoctadine triacetate, iminoctadine tris(albesilate), ipconazole, iprobenfos, iprodione, iprovalicarb, isoprothiolane, isopyrazam, isotianil, kasugamycin, kasugamycin hydrochloride hydrate, kresoxim-methyl, mancopper, mancozeb, mandipropamid, maneb, mepanipyrim, mepronil, mercuric chloride, mercuric oxide, mercurous chloride, metalaxyl, mefenoxam, metalaxyl-M, metam, metam-ammonium, metam-potassium, metam-sodium, metconazole, methasulfocarb, methyl iodide, methyl isothiocyanate, metiram, metominostrobin, metrafenone, mildiomycin, myclobutanil, nabam, nitrothal-isopropyl, nuarimol, octhilinone, ofurace, oleic acid (fatty acids), orysastrobin, oxadixyl, oxine-copper, oxpoconazole fumarate, oxycarboxin, pefurazoate, penconazole, pencycuron, penflufen, pentachlorophenol, pentachlorophenyl laurate, penthiopyrad, phenylmercury acetate, phosphonic acid, phthalide, picoxystrobin, polyoxin B, polyoxins, polyoxorim, potassium bicarbonate, potassium hydroxyquinoline sulfate, probenazole, prochloraz, procymidone, propamocarb, propamocarb hydrochloride, propiconazole, propineb, proquinazid, prothioconazole, pyraclostrobin, pyrametostrobin, pyraoxystrobin, pyrazophos, pyribencarb, pyributicarb, pyrifenox, pyrimethanil, pyroquilon, quinoclamine, quinoxyfen, quintozene, Reynoutria sachalinensis extract, sedaxane, silthiofam, simeconazole, sodium 2-phenylphenoxide, sodium bicarbonate, sodium pentachlorophenoxide, spiroxamine, sulfur, SYP-Z071, SYP-Z048, tar oils, tebuconazole, tebufloquin, tecnazene, tetraconazole, thiabendazole, thifluzamide, thiophanate-methyl, thiram, tiadinil, tolclofos-methyl, tolylfluanid, triadimefon, triadimenol, triazoxide, tricyclazole, tridemorph, trifloxystrobin, triflumizole, triforine, triticonazole, validamycin, valifenalate, valiphenal, vinclozolin, zineb, ziram, zoxamide, *Candida oleophila*, *Fusarium oxysporum*, *Gliocladium* spp., *Phlebiopsis gigantea*, *Streptomyces griseoviridis*, *Trichoderma* spp., (RS)-N-(3,5-dichlorophenyl)-2-(methoxymethyl)-succinimide, 1,2-dichloropropane, 1,3-dichloro-1,1,3,3-tetrafluoroacetone hydrate, 1-chloro-2,4-dinitronaphthalene, 1-chloro-2-nitropropane, 2-(2-heptadecyl-2-imidazolin-1-yl)ethanol, 2,3-dihydro-5-phenyl-1,4-dithi-ine 1,1,4,4-tetraoxide, 2-methoxyethylmercury acetate, 2-methoxyethylmercury chloride, 2-methoxyethylmercury silicate, 3-(4-chlorophenyl)-5-methylrhodanine, 4-(2-nitroprop-1-enyl)phenyl thiocyanateme, ampropylfos, anilazine, azithiram, barium polysulfide, Bayer 32394, benodanil, benquinox, bentaluron, benzamacril; benzamacril-isobutyl, benzamorf, binapacryl, bis(methylmercury) sulfate, bis(tributyltin) oxide, buthiobate, cadmium calcium copper zinc chromate sulfate, carbamorph, CECA, chlobenthiazone, chloraniformethan, chlorfenazole, chlorquinox, climbazole, cyclafuramid, cypendazole, cyprofuram, decafentin, dichlone, dichlozoline, diclobutrazol, dimethirimol, dinocton, dinosulfon, dinoterbon, dipyrithione, ditalimfos, dodicin, drazoxolon, EBP, ESBP, etaconazole, etem, ethirim, fenaminosulf, fenapanil, fenitropan, 5-fluorocytosine and profungicides thereof, fluotrimazole, furcarbanil, furconazole, furconazole-cis, furmecyclox, furophanate, glyodine, griseofulvin, halacrinate, Hercules 3944, hexylthiofos, ICIA0858, isopamphos, isovaledione, mebenil, mecarbinzid, metazoxolon, methfuroxam, methylmercury dicyandiamide, metsulfovax, milneb, mucochloric anhydride, myclozolin, N-3,5-dichlorophenyl-succinimide, N-3-

TABLE I-continued

Fungicides commonly used in agriculture nitrophenylitaconimide, natamycin, N-ethylmercurio-4-toluenesulfonanilide, nickel bis(dimethyldithiocarbamate), OCH, phenylmercury dimethyldithiocarbamate, phenylmercury nitrate, phosdiphen, picolinamide UK-2A and derivatives thereof, prothiocarb; prothiocarb hydrochloride, pyracarbolid, pyridinitril, pyroxychlor, pyroxyfur, quinacetol; quinacetol sulfate, quinazamid, quinconazole, rabenzazole, salicylanilide, SSF-109, sultropen, tecoram, thiadifluor, thicyofen, thiochlorfenphim, thiophanate, thioquinox, tioxymid, triamiphos, triarimol, triazbutil, trichlamide, urbacid, XRD-563, and zarilamide, IK-1140.

TABLE J

Popular Fungicides

| Crop | Popular Fungicides Used |
|---|---|
| Corn | Syngenta Maxim Quattro (mefenoxam, fludioxonil, azoxystrobin & thiabendazole; systemic action, "cleans up surface and internal pathogens"; targeted at Fusarium, broad spectrum); Monsanto Acceleron: DC-309 (metalaxyl), DC-509 (ipconazole), DX-709 (trifloxystrobin); BASF: Stamina (pyraclostrobin), Stamina F3 (pyraclostrobin, triticonazole, metalaxyl) |
| Soybean | Monsanto Acceleron: DX-109 (pyraclostrobin), DX-309 (metalaxyl), Bayer EverGol Energy (prothioconazole, metalaxyl & penflufen); |
| Wheat | BASF: Charter F2 (triticonazole, metalaxyl), Stamina (pyraclostrobin), Stamina F3 (pyraclostrobin, triticonazole, metalaxyl), Charter (triticonazole); Syngenta Dividend (difenoconazole); |

TABLE K

COMMON HERBICIDES

4-CPA; 4-CPB; 4-CPP; 2,4-D; 3,4-DA; 2,4-DB; 3,4-DB; 2,4-DEB; 2,4-DEP; 3,4-DP; 2,3,6-TBA; 2,4,5-T; 2,4,5-TB; acetochlor, acifluorfen, aclonifen, acrolein, alachlor, allidochlor, alloxydim, allyl alcohol, alorac, ametridione, ametryn, amibuzin, amicarbazone, amidosulfuron, aminocyclopyrachlor, aminopyralid, amiprofos-methyl, amitrole, ammonium sulfamate, anilofos, anisuron, asulam, atraton, atrazine, azafenidin, azimsulfuron, aziprotryne, barban, BCPC, beflubutamid, benazolin, bencarbazone, benfluralin, benfuresate, bensulfuron, bensulide, bentazone, benzadox, benzfendizone, benzipram, benzobicyclon, benzofenap, benzofluor, benzoylprop, benzthiazuron, bicyclopyrone, bifenox, bilanafos, bispyribac, borax, bromacil, bromobonil, bromobutide, bromofenoxim, bromoxynil, brompyrazon, butachlor, butafenacil, butamifos, butenachlor, buthidazole, buthiuron, butralin, butroxydim, buturon, butylate, cacodylic acid, cafenstrole, calcium chlorate, calcium cyanamide, cambendichlor, carbasulam, carbetamide, carboxazole chlorprocarb, carfentrazone, CDEA, CEPC, chlomethoxyfen, chloramben, chloranocryl, chlorazifop, chlorazine, chlorbromuron, chlorbufam, chloreturon, chlorfenac, chlorfenprop, chlorflurazole, chlorflurenol, chloridazon, chlorimuron, chlornitrofen, chloropon, chlorotoluron, chloroxuron, chloroxynil, chlorpropham, chlorsulfuron, chlorthal, chlorthiamid, cinidon-ethyl, cinmethylin, cinosulfuron, cisanilide, clethodim, cliodinate, clodinafop, clofop, clomazone, clomeprop, cloprop, cloproxydim, clopyralid, cloransulam, CMA, copper sulfate, CPMF, CPPC, credazine, cresol, cumyluron, cyanatryn, cyanazine, cycloate, cyclosulfamuron, cycloxydim, cycluron, cyhalofop, cyperquat, cyprazine, cyprazole, cypromid, daimuron, dalapon, dazomet, delachlor, desmedipham, desmetryn, di-allate, dichlobenil, dichloralurea, dichlormate, dichlorprop, dichlorprop-P, diclofop, diclosulam, diethamquat, diethatyl, difenopenten, difenoxuron, difenzoquat, diflufenican, diflufenzopyr, dimefuron, dimepiperate, dimethachlor, dimethametryn, dimethenamid, dimethenamid-P, dimexano, dimidazon, dinitramine, dinofenate, dinoprop, dinosam, dinoseb, dinoterb, diphenamid, dipropetryn, diquat, disul, dithiopyr, diuron, DMPA, DNOC, DSMA, EBEP, eglinazine, endothal, epronaz, EPTC, erbon, esprocarb, ethalfluralin, ethametsulfuron, ethidimuron, ethiolate, ethofumesate, ethoxyfen, ethoxysulfuron, etinofen, etnipromid, etobenzanid, EXD, fenasulam, fenoprop, fenoxaprop, fenoxaprop-P, fenoxasulfone, fenteracol, fenthiaprop, fentrazamide, fenuron, ferrous sulfate, flamprop, flamprop-M, flazasulfuron, florasulam, fluazifop, fluazifop-P, fluazolate, flucarbazone, flucetosulfuron, fluchloralin, flufenacet, flufenican, flufenpyr, flumetsulam, flumezin, flumiclorac, flumioxazin, flumipropyn, fluometuron, fluorodifen, fluoroglycofen, fluoromidine, fluoronitrofen, fluothiuron, flupoxam, flupropacil, flupropanate, flupyrsulfuron, fluridone, flurochloridone, fluroxypyr, flurtamone, fluthiacet, fomesafen, foramsulfuron, fosamine, furyloxyfen, glufosinate, glufosinate-P, halosafen, halosulfuron, haloxydine, haloxyfop, haloxyfop-P, hexachloroacetone, hexaflurate, hexazinone, imazamethabenz, imazamox, imazapic, imazapyr, imazaquin, imazethapyr, imazosulfuron, indanofan, indaziflam, iodobonil, iodomethane, iodosulfuron, ioxynil, ipazine, ipfencarbazone, iprymidam, isocarbamid, isocil, isomethiozin, isonoruron, isopolinate, isopropalin, isoproturon, isouron, isoxaben, isoxachlortole, isoxaflutole, isoxapyrifop, karbutilate, ketospiradox, lactofen, lenacil, linuron, MAA, MAMA, MCPA, MCPA-thioethyl, MCPB, mecoprop, mecoprop-P, medinoterb, mefenacet, mefluidide, mesoprazine, mesosulfuron, mesotrione, metam, metamifop, metamitron, metazachlor, metazosulfuron, metflurazon, methabenzthiazuron, methalpropalin, methazole, methiobencarb, methiozolin, methiuron, methometon, methoprotryne, methyl bromide, methyl isothiocyanate, methyldymron, metobenzuron, metobromuron, metolachlor, metosulam, metoxuron, metribuzin, metsulfuron, molinate, monalide, monisouron, monochloroacetic acid, monolinuron, monuron, morfamquat, MSMA, naproanilide, napropamide, naptalam, neburon, nicosulfuron, nipyraclofen, nitralin, nitrofen, nitrofluorfen, norflurazon, noruron, OCH, orbencarb, ort/zo-dichlorobenzene, orthosulfamuron, oryzalin, oxadiargyl, oxadiazon, oxapyrazon, oxasulfuron, oxaziclomefone, oxyfluorfen, parafluron, paraquat, pebulate, pelargonic acid, pendimethalin,

TABLE K-continued

COMMON HERBICIDES penoxsulam, pentachlorophenol, pentanochlor, pentoxazone, perfluidone, pethoxamid, phenisopham, phenmedipham, phenmedipham-ethyl, phenobenzuron, phenylmercury acetate, picloram, picolinafen, pinoxaden, piperophos, potassium arsenite, potassium azide, potassium cyanate, pretilachlor, primisulfuron, procyazine, prodiamine, profluazol, profluralin, profoxydim, proglinazine, prometon, prometryn, propachlor, propanil, propaquizafop, propazine, propham, propisochlor, propoxycarbazone, propyrisulfuron, propyzamide, prosulfalin, prosulfocarb, prosulfuron, proxan, prynachlor, pydanon, pyraclonil, pyraflufen, pyrasulfotole, pyrazolynate, pyrazosulfuron, pyrazoxyfen, pyribenzoxim, pyributicarb, pyriclor, pyridafol, pyridate, pyriftalid, pyriminobac, pyrimisulfan, pyrithiobac, pyroxasulfone, pyroxsulam, quinclorac, quinmerac, quinoclamine, quinonamid, quizalofop, quizalofop-P, rhodethanil, rimsulfuron, saflufenacil, S-metolachlor, sebuthylazine, secbumeton, sethoxydim, siduron, simazine, simeton, simetryn, SMA, sodium arsenite, sodium azide, sodium chlorate, sulcotrione, sulfallate, sulfentrazone, sulfometuron, sulfosulfuron, sulfuric acid, sulglycapin, swep, TCA, tebutam, tebuthiuron, tefuryltrione, tembotrione, tepraloxydim, terbacil, terbucarb, terbuchlor, terbumeton, terbuthylazine, terbutryn, tetrafluron, thenylchlor, thiazafluron, thiazopyr, thidiazimin, thidiazuron, thiencarbazone-methyl, thifensulfuron, thiobencarb, tiocarbazil, tioclorim, topramezone, tralkoxydim, tri-allate, triasulfuron, triaziflam, tribenuron, tricamba, triclopyr, tridiphane, trietazine, trifloxysulfuron, trifluralin, triflusulfuron, trifop, trifopsime, trihydroxytriazine, trimeturon, tripropindan, tritac tritosulfuron, vernolate and xylachlor.

TABLE L

PLANT GROWTH REGULATORS

DB, 2,4-DEP, dichlorprop, fenoprop, IAA, IBA, naphthaleneacetamide, α-naphthaleneacetic acid, 1-naphthol, naphthoxyacetic acid, potassium naphthenate, sodium naphthenate, 2,4,5-T; cytokinins such as 2iP, benzyladenine, kinetin, zeatin; defoliants such as calcium cyanamide, dimethipin, endothal, ethephon, merphos, metoxuron, pentachlorophenol, thidiazuron, tribufos; ethylene inhibitors such as aviglycine, 1-methylcyclopropene; ethylene releasers such as ACC, etacelasil, ethephon, glyoxime; gibberellins such as gibberellins, gibberellic acid; growth inhibitors such as abscisic acid, ancymidol, butralin, carbaryl, chlorphonium, chlorpropham, dikegulac, flumetralin, fluoridamid, fosamine, glyphosine, isopyrimol, jasmonic acid, maleic hydrazide, mepiquat, mepiquat, piproctanyl, prohydrojasmon, propham, 2,3,5-tri-iodobenzoic acid; morphactins such as chlorfluren, chlorflurenol, dichlorflurenol, flurenol; growth retardants such as chlormequat, daminozide, flurprimidol, mefluidide, paclobutrazol tetcyclacis, uniconazole; growth stimulators such as brassinolide, forchlorfenuron, hymexazol; and unclassified plant growth regulators such as benzofluor, buminafos, carvone, ciobutide, clofencet, cloxyfonac, cyanamide, cyclanilide, cycloheximide, cyprosulfamide, epocholeone, ethychlozate, ethylene, fenridazon, heptopargil, holosulf, inabenfide, karetazan, lead arsenate, methasulfocarb, prohexadione, pydanon, sintofen, triapenthenol, and trinexapac.

TABLE M

INSECTICIDES

Antibiotic insecticides such as allosamidin and thuringiensin; macrocyclic lactone insecticides such as spinosad, spinetoram, and other spinosyns including the 21-butenyl spinosyns and their derivatives; avermectin insecticides such as abamectin, doramectin, emamectin, eprinomectin, ivermectin and selamectin; milbemycin insecticides such as lepimectin, milbemectin, milbemycin oxime and moxidectin; arsenical insecticides such as calcium arsenate, copper acetoarsenite, copper arsenate, lead arsenate, potassium arsenite and sodium arsenite; biological insecticides such as *Bacillus popilliae*, *B. sphaericus*, *B. thuringiensis* subsp. *aizawai*, *B. thuringiensis* subsp. *kurstaki*, *B. thuringiensis* subsp. *tenebrionis*, *Beauveria bassiana*, *Cydia pomonella* granulosis virus, Douglas fir tussock moth NPV, gypsy moth NPV, *Helicoverpa zea* NPV, Indian meal moth granulosis virus, *Metarhizium anisopliae*, *Nosema locustae*, *Paecilomyces fumosoroseus*, *P. lilacinus*, *Photorhabdus luminescens*, *Spodoptera exigua* NPV, trypsin modulating oostatic factor, *Xenorhabdus nematophilus*, and *X. bovienii*, plant incorporated protectant insecticides such as Cry1Ab, Cry1Ac, Cry1F, Cry1A.105, Cry2Ab2, Cry3A, mir Cry3A, Cry3Bb1, Cry34, Cry35, and VIP3A; botanical insecticides such as anabasine, azadirachtin, d-limonene, nicotine, pyrethrins, cinerins, cinerin I, cinerin II, jasmolin I, jasmolin II, pyrethrin I, pyrethrin II, quassia, rotenone, ryania and sabadilla; carbamate insecticides such as bendiocarb and carbaryl; benzofuranyl methylcarbamate insecticides such as benfuracarb, carbofuran, carbosulfan, decarbofuran and furathiocarb; dimethylcarbamate insecticides dimitan, dimetilan, hyquincarb and pirimicarb; oxime carbamate insecticides such as alanycarb, aldicarb, aldoxycarb, butocarboxim, butoxycarboxim, methomyl, nitrilacarb, oxamyl, tazimcarb, thiocarboxime, thiodicarb and thiofanox; phenyl methylcarbamate insecticides such as allyxycarb, aminocarb, bufencarb, butacarb, carbanolate, cloethocarb, dicresyl, dioxacarb, EMPC, ethiofencarb, fenethacarb, fenobucarb, isoprocarb, methiocarb, metolcarb, mexacarbate, promacyl, promecarb, propoxur, trimethacarb, XMC and xylylcarb; dinitrophenol insecticides such as dinex, dinoprop, dinosam and DNOC; fluorine insecticides such as barium hexafluorosilicate, cryolite, sodium fluoride, sodium hexafluorosilicate and sulfluramid; formamidine insecticides such as amitraz, chlordimeform, formetanate and formparanate; fumigant insecticides such as acrylonitrile, carbon disulfide, carbon tetrachloride, chloroform, chloropicrin, para-dichlorobenzene, 1,2-dichloropropane, ethyl formate, ethylene dibromide, ethylene dichloride, ethylene oxide, hydrogen cyanide, iodomethane, methyl bromide, methylchloroform, methylene chloride, naphthalene, phosphine, sulfuryl fluoride and tetrachloroethane; inorganic insecticides such as borax, calcium

TABLE M-continued

INSECTICIDES polysulfide, copper oleate, mercurous chloride, potassium thiocyanate and sodium thiocyanate; chitin synthesis inhibitors such as bistrifluoron, buprofezin, chlorfluazuron, cyromazine, diflubenzuron, flucycloxuron, flufenoxuron, hexaflumuron, lufenuron, novaluron, noviflumuron, penfluoron, teflubenzuron and triflumuron; juvenile hormone mimics such as epofenonane, fenoxycarb, hydroprene, kinoprene, methoprene, pyriproxyfen and triprene; juvenile hormones such as juvenile hormone I, juvenile hormone II and juvenile hormone III; moulting hormone agonists such as chromafenozide, halofenozide, methoxyfenozide and tebufenozide; moulting hormones such as α-ecdysone and ecdysterone; moulting inhibitors such as diofenolan; precocenes such as precocene I, precocene II and precocene III; unclassified insect growth regulators such as dicyclanil; nereistoxin analogue insecticides such as bensultap, cartap, thiocyclam and thiosultap; nicotinoid insecticides such as flonicamid; nitroguanidine insecticides such as clothianidin, dinotefuran, imidacloprid and thiamethoxam; nitromethylene insecticides such as nitenpyram and nithiazine; pyridylmethylamine insecticides such as acetamiprid, imidacloprid, nitenpyram and thiacloprid; organochlorine insecticides such as bromo-DDT, camphechlor, DDT, pp'-DDT, ethyl-DDD, HCH, gamma-HCH, lindane, methoxychlor, pentachlorophenol and TDE; cyclodiene insecticides such as aldrin, bromocyclen, chlorbicyclen, chlordane, chlordecone, dieldrin, dilor, endosulfan, endrin, HEOD, heptachlor, HHDN, isobenzan, isodrin, kelevan and mirex; organophosphate insecticides such as bromfenvinfos, chlorfenvinphos, crotoxyphos, dichlorvos, dicrotophos, dimethylvinphos, fospirate, heptenophos, methocrotophos, mevinphos, monocrotophos, naled, naftalofos, phosphamidon, propaphos, TEPP and tetrachlorvinphos; organothiophosphate insecticides such as dioxabenzofos, fosmethilan and phenthoate; aliphatic organothiophosphate insecticides such as acethion, amiton, cadusafos, chlorethoxyfos, chlormephos, demephion, demephion-O, demephion-S, demeton, demeton-O, demeton-S, demeton-methyl, demeton-O-methyl, demeton-S-methyl, demeton-S-methylsulphon, disulfoton, ethion, ethoprophos, IPSP, isothioate, malathion, methacrifos, oxydemeton-methyl, oxydeprofos, oxydisulfoton, phorate, sulfotep, terbufos and thiometon; aliphatic amide organothiophosphate insecticides such as amidithion, cyanthoate, dimethoate, ethoate-methyl, formothion, mecarbam, omethoate, prothoate, sophamide and vamidothion; oxime organothiophosphate insecticides such as chlorphoxim, phoxim and phoxim-methyl; heterocyclic organothiophosphate insecticides such as azamethiphos, coumaphos, coumithoate, dioxathion, endothion, menazon, morphothion, phosalone, pyraclofos, pyridaphenthion and quinothion; benzothiopyran organothiophosphate insecticides such as dithicrofos and thicrofos; benzotriazine organothiophosphate insecticides such as azinphos-ethyl and azinphos-methyl; isoindole organothiophosphate insecticides such as dialifos and phosmet; isoxazole organothiophosphate insecticides such as isoxathion and zolaprofos; pyrazolopyrimidine organothiophosphate insecticides such as chlorprazophos and pyrazophos; pyridine organothiophosphate insecticides such as chlorpyrifos and chlorpyrifos-methyl; pyrimidine organothiophosphate insecticides such as butathiofos, diazinon, etrimfos, lirimfos, pirimiphos-ethyl, pirimiphos-methyl, primidophos, pyrimitate and tebupirimfos; quinoxaline organothiophosphate insecticides such as quinalphos and quinalphos-methyl; thiadiazole organothiophosphate insecticides such as athidathion, lythidathion, methidathion and prothidathion; triazole organothiophosphate insecticides such as isazofos and triazophos; phenyl organothiophosphate insecticides such as azothoate, bromophos, bromophos-ethyl, carbophenothion, chlorthiophos, cyanophos, cythioate, dicapthon, dichlofenthion, etaphos, famphur, fenchlorphos, fenitrothion fensulfothion, fenthion, fenthion-ethyl, heterophos, jodfenphos, mesulfenfos, parathion, parathion-methyl, phenkapton, phosnichlor, profenofos, prothiofos, sulprofos, temephos, trichlormetaphos-3 and trifenofos; phosphonate insecticides such as butonate and trichlorfon; phosphonothioate insecticides such as mecarphon; phenyl ethylphosphonothioate insecticides such as fonofos and trichloronat; phenyl phenylphosphonothioate insecticides such as cyanofenphos, EPN and leptophos; phosphoramidate insecticides such as crufomate, fenamiphos, fosthietan, mephosfolan, phosfolan and pirimetaphos; phosphoramidothioate insecticides such as acephate, isocarbophos, isofenphos, methamidophos and propetamphos; phosphorodiamide insecticides such as dimefox, mazidox, mipafox and schradan; oxadiazine insecticides such as indoxacarb; phthalimide insecticides such as dialifos, phosmet and tetramethrin; pyrazole insecticides such as acetoprole, ethiprole, fipronil, pyrafluprole, pyriprole, tebufenpyrad, tolfenpyrad and vaniliprole; pyrethroid ester insecticides such as acrinathrin, allethrin, bioallethrin, barthrin, bifenthrin, bioethanomethrin, cyclethrin, cycloprothrin, cyfluthrin, beta-cyfluthrin, cyhalothrin, gamma-cyhalothrin, lambda-cyhalothrin, cypermethrin, alpha-cypermethrin, beta-cypermethrin, theta-cypermethrin, zeta-cypermethrin, cyphenothrin, deltamethrin, dimefluthrin, dimethrin, empenthrin, fenfluthrin, fenpirithrin, fenpropathrin, fenvalerate, esfenvalerate, flucythrinate, fluvalinate, tau-fluvalinate, furethrin, imiprothrin, metofluthrin, permethrin, biopermethrin, transpermethrin, phenothrin, prallethrin, profluthrin, pyresmethrin, resmethrin, bioresmethrin, cismethrin, tefluthrin, terallethrin, tetramethrin, tralomethrin and transfluthrin; pyrethroid ether insecticides such as etofenprox, flufenprox, halfenprox, protrifenbute and silafluofen; pyrimidinamine insecticides such as flufenerim and pyrimidifen; pyrrole insecticides such as chlorfenapyr; tetronic acid insecticides such as spirodiclofen, spiromesifen and spirotetramat; thiourea insecticides such as diafenthiuron; urea insecticides such as flucofuron and sulcofuron; and unclassified insecticides such as AKD-3088, closantel, crotamiton, cyflumetofen, E2Y45, EXD, fenazaflor, fenazaquin, fenoxacrim, fenpyroximate, FKI-1033, flubendiamide, HGW86, hydramethylnon, IKI-2002, isoprothiolane, malonoben, metaflumizone, metoxadiazone, nifluridide, NNI-9850, NNI-0101, pymetrozine, pyridaben, pyridalyl, Qcide, rafoxanide, rynaxypyr, SYJ-159, triarathene and triazamate.

TABLE N

NEMATICIDE

Biological: *Bacillus firmus*, *Paecilomyces lilacinus* str. 251
Chemical: avermectin nematicides, such as abamectin; carbamate nematicides, such as, aldicarb, thiadicarb, carbofuran, carbosulfan, oxamyl, aldoxycarb, ethoprop, methomyl, benomyl, alanycarb; and organophosphorus nematicides, such as, fenamiphos, fensulfothion, terbufos, fosthiazate, dimethoate, phosphocarb, dichlofenthion, isamidofos, fosthietan, isazofos ethoprophos, cadusafos, terbufos, chlorpyrifos, dichlofenthion, heterophos, isamidofos, mecarphon, phorate, thionazin, triazophos, diamidafos, fosthietan and phosphamidon (WO 2012/140212 A2)
Nematophagous fungi useful herein include, but are not limited to, *Arthrobotrys* spp., for example, *Arthrobotrys oligospora*, *Arthrobotrys superb* and *Arthrobotrys dactyloides*; *Dactylaria* spp., for example, *Dactylaria Candida*; *Harposporium* spp., for example, *Harposporium anguillulae*; *Hirsutella* spp., for example, *Hirsutella rhossiliensis* and *Hirsutella minnesotensis*, *Monacrosporium* spp., for example, *Monacrosporium cionopagum*; *Nematoctonus* spp., for example, *Nematoctonus geogenius*, *Nematoctonus leiosporus*; *Meristacrum* spp., for example, *Meristacrum asterospermum*; *Harposporium* spp., for example, *Harposporium anguillulae*; *Paecilomyces* spp., for example, *Paecilomyces lilacinus*; *Pochonia* spp., for example, *Pochonia chlamydopora* and *Streptomyces* spp.
Nematophagous bacteria useful herein include, but are not limited to, obligate parasitic bacteria, opportunistic parasitic bacteria, rhizobacteria, parasporal Cry protein-forming bacteria, endophytic bacteria and symbiotic bacteria. In particular embodiments, the biocontrol agent can be a bacteria species selected from *Actinomycetes* spp., *Agrobacterium* spp., *Allorhizobium* spp., *Arthrobacter* spp., *Alcaligenes* spp., *Aureobacterium* spp., *Azobacter* spp., *Azorhizobium* spp., *Azospirillium* spp., *Beijerinckia* spp., *Bradyrhizobium* spp., *Burkholderia* spp., *Chromobacterium* spp., *Clavibacter* spp., *Clostridium* spp., *Comomonas* spp., *Corynebacterium* spp., *Curtobacterium* spp., *Desulforibtio* spp., *Enterobacter* spp., *Flavobacterium* spp., *Gluconobacter* spp., *Hydrogenophage* spp., *Klebsiella* spp., *Methylobacterium* spp., *Phyllobacterium* spp., *Phingobacterium* spp., *Photorhabdus* spp., *Rhizobium* spp., *Serratia* spp., *Stenotrotrophomonas* spp., *Xenorhadbus* spp. *Variovorax* spp., *Pasteuria* spp., *Pseudomonas* spp., and *Paenibacillus* spp.

TABLE O

List of Plant Associated Microbes

*Gliocladium virens, Paecilomyces fumosoroseus, Bacillus thuringiensis, Paecilomyces lilacinus, Paenibacillus polymyxa, Neotyphodium lolii, Neotyphodium uncinatum, Ampelomyces quisqualis, Beauvaria bassiana, Azospirillum brasilense, Trichoderma harzianum, Lecanicillium muscarium, Gliocladium catenulatum, Streptomyces ray, Glomus intraradices, Bacillus amyloliquefaciens, Clonostachys Rosea, Beauveria bassiana, Chromobacterium subtsugae, Bacillus subtilus, Trichoderma lignorum, Streptomyces lydicus, Paecilomyces fumorosoroseus, Penicillium bilaii, Bacillus pumilus, Sclerotinia minor, Trichoderma viride, Chaetomium globosum, Pseudomonas fluorescens, Bacillus subtilis, Glomus fasciculatum, Frateuria aurantia, Bacillus megaterium, Thiobacillus Thiooxidans, Metarhizium anisopliae, Verticillium lecanii, Methylobacterium mesophilicum, Methylobacterium organophilum, Methylobacterium extorquens, Bacillus thuringiensis,, Myrothecium verrucaria, Bacillus subtilis, Fusarium oxysporum, Trichoderma asperellum, Coniothyrium minitans, Saccharopolyspora spinosa, Mesorhizobium ciceri, Bradyrhizobium japonicum, Sinorhizobium meliloti, Rhizobium leguminosarum, Bradyrhizobium japnicum, Delftia acidivorans, Agrobacterium radiobacter, Aspergillus flavus, Candida oleophila, Pseudozyma flocculosa, Pythium oligandrum, Ulocladium oudemansii, Phlebia gigantean, Metschnikowia fructicola, Aspergillus niger, Ophiostoma piliferum, Fomes fomentarius, Aschersonia aleyrodis, Beauveria brongniartii, Hirsutella thompsonii, Isaria fumosorosea, Lecanicillium longisporum, Nomuraea rileyi, Sporothrix insectorum, Conidiobolus thromboides, Lagenidium giganteum, Trichoderma gamsii, Trichoderma virens, Burkholderia phytofirmans, Piriformospora indica, Sebacina vermifera, Klebsiella pneumoniae, Pantoea agglomerans, Gluconacetobacter diazotrophicus, Herbaspirillum seropedicae, Methylobacterium fujisawaense, Methylobacterium oryzae, Ralstonia eutropha, Achromobacter piechaudii, Pseudomonas mendocina, Fusarium culmorum, Curvularia protuberata, Bacillus cereus, Bacillus amylilquofaciens, Bacillus mycoides, Bacillus pasteurii, Burkholderia vietnamiensis, Enterobacter aerogenes, Azospirillum lipoferum, Pseudomonas entomophila, Pseudomonas stutzeri, Pseudomonas putida, Pseudomonas syringae, Pseudomonas monteilli, Azotobacter chroococcum, Klebsiella pneumoniae, Burkholderia cepacia, Azorhizobium caulinodans, Aeromonas hydrophila, Serratia liquefaciens, Serratia proteamaculans, Leptodontidium orchidicola, Pleosporales* Unknown, *Verticillium dahliae, Neotyphodium coenophialum, Colletotrichum magna, Colletotrichum musae, Colletotrichum orbiculare, Rhodotorula mucilaginosa, Glomus mosseae, Chryseobacterium indologene, Acinetobacter johnsonii, Chaetomium chiversii, Paraphaeosphaeria quadriseptata, Paecilomyces formosus,* and *Penicillium minioluteum*

SEQUENCE LISTING (2578 sequences)

SEQ ID NO: 1 - DNA, 687 bp, Burkholderia fungorum
cgacttggaggttgtgcccttgaggcgtggtttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacgggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 2 - DNA, 687 bp, Burkholderia fungorum
cgacttggaggttgtgcccttgaggcgtggcttcccgagctaacgcgttaagtcgaccgcctggggagtacggccgcaaggttaaaactcaaatgaattgacgggggcccgcacaagcggtggagcatgtggtttaattcgatgcaacgcgaagagccttacctggtcttgacatccacggaatttggcagagatgccttagtgccttcgggaaccgtgagacaggtgctgcatggctgtcgtcagctcgtgttgtgaaatattaggttaagtcccgcaacgagcgcaacccttatcctttgttgccagcggtccggccgggaactcaaaggagactgtcagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 3 - DNA, 687 bp, Burkholderia gladioli
cgacttggaggttgtgcccttgaggcgtggcttccggagctaacgcgtcaagtcgaccgcctggggagtacggccgcaaggttaagactcaaatgaattgacgggggcccgcacaagcggtggagcatgtggtttaattcgatgcaacgcgaagaaccttacctactcttggcatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 4 - DNA, 687 bp, Citrobacter freundii
cgacttggaggttgggcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaacttcgggagggcgcttaccactttgtgattcatgactggggtgaagtcgtaacaaggtacc

SEQ ID NO: 5 - DNA, 687 bp, Citrobacter freundii
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacagtggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagc

SEQ ID NO: 6 - DNA, 687 bp, Clostridium acetobutylicum
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgctgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 7 - DNA, 687 bp, Clostridium beijerinckii
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgagccttgtacacaccgcccgtcacaccatgggagtgggttgcaaaagaagtaggtagcttaaacttcgggagggcgcttaccactttgtgattcatgactggggtgaagtcgtaacaaggtacc

SEQ ID NO: 8 - DNA, 687 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagc

SEQ ID NO: 9 - DNA, 685 bp, Enterobacter asburiae
gacttggaggttgtgccttgaggcgtggcttcccgagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcacgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 10 - DNA, 687 bp, Enterobacter aerogenes
cgacttggaggttgtgcccttgaggcgtggcttccggagctaacgcgttaagtcgaccgcctggggagtacggccgcaaggttaaaactcaaatgaattgacgggggcccgcacgagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgctgggttaagtcccgcaacgagcgcaacccttatcctttgttgccagcggtccggccgtgaactcaaaggagactgccagtgataaactggaggaaggtggggatgacgtcaagtcatcatggcccttacgagtagggctacacacctgctacaatggcgcatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 11 - DNA, 687 bp, Enterobacter aerogenes
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttggcatccagagaacttagcagagatgctttggtgccttcgggaactctgagacaggtgctgcatggctgtcgtcagctcgtgttgtgaaatgttgggttaagtcccgcaacgggcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 12 - DNA, 531 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccctatcctttgttgccagcggtccggccgggaactcaaaggagactgccagtgataaactggaggaaggtggggatgacgtcaagtcatcatggcccttacgaccagggctacacacgtgctacaatggcgcacacaaagagaagcaatctcgcgagagctagcggacctcataaagcgcgtcgtagtccggattggagtctgcaactcgactccatgaagtcggaatcgttagtaatcg

SEQ ID NO: 13 - DNA, 686 bp, Enterobacter asburiae
cgacttggaggttgtgcccttgaggcgtggcttccggagctaacgcgtcaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcacaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagagtgctacggtgaatacgttcccgggccttgtacacaccgcccgtcacaccatgggagtgggttgcaatagaagtgtatagcttcggttagtgagggcgcaatccacgtcataactgctgactggagtgaagtcgtaacaaggtaac

SEQ ID NO: 14 - DNA, 687 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggcgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtctttccaagatccc

SEQ ID NO: 15 - DNA, 686 bp, Enterobacter asburiae
cgacttggaggttgtgcccctgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacgcaccgcccgtcacaccataaagtgggttgcaaaagaagtaggtagcttaaccttcgggagggcgcttaccactttgtgattcatgactggggtgaagacgtaacaaggtaac

SEQ ID NO: 16 - DNA, 687 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgctgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggaggacgcttaccactttgtgattcatgactggggtgaagtcgtaacaaggtatc

SEQ ID NO: 17 - DNA, 687 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 18 - DNA, 512 bp, Enterobacter asburiae
attcagaacttggcagagatgccttggtgccttcgggaactgtgagacaggtgctgcatggctgtcgtcagctcgtgttgtgaaatgttgggttaagtcccgcaatgagcgcaacccttatcctttgttgccagcggttaggccgggaactcaaaggagaccgccagtgataaactggaggaaggtggggatgacgtcaagtcatcatggcccttacgaccagggctacacacgtgctacaatggcgcatacaaagagaagcaaactcgcgagagcaagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 19 - DNA, 674 bp, Enterobacter asburiae
cgacttggaggttgtgcccttgaggcgtggcttccggagctaacgcgttaagtcgaccgcctggggagtacggccgcaaggttaaaactcaaatgaattggcgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgtcgccagcggttaggccgggaactcaaaggagactgccagtgataaactggaggaaggtggggatgacgtcaagtcatcatggcccttacgaccagggctacacacgtgctacaatggcgcatacaaagagtagcaatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 20 - DNA, 685 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactcggcagagatgccttggtgccttcgggaactgtgagacaggtgctgcatggctgtcgtcagctcgtgttgtgaaatgttaggttaagtcccgcaacgagcgcaacccttatcctttgttgccagcggttaggccgggaactcaaaggagactgccagtgataaactggaggaaggtgggatgacgtcaagtcaccatggcccttacgaccagggctacacacgtgctacaatggcgcatacaaagagaagcaatctcgcgagagctagcggacctcataaagtgcgtcgtagtccggattgaagtctgcaactcgactccatgaagtcggaatcgctagtaatcgtgaatcagaatgtcacgttaatacgttcccgggccttgtacacaccgcccgtcacaccatgggagtgggttgcaaaagaagtaggtagcttaccttcgggagggcgcttaccacttttgtgattcatgactggggtgaagtcgtaacaaggtacc

SEQ ID NO: 21 - DNA, 687 bp, Enterobacter asburiae
cgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 22 - DNA, 689 bp, Enterobacter cloacae
caactggatattggtctcactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaaagtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacggagtgtttcatgactggggtgaagtcgtaacaaggtaac

SEQ ID NO: 23 - DNA, 691 bp, Enterobacter cloacae
gcgctggatgttgggtgacctagtcactcagtgtcgtagctaacgcgataagcgcaccgcctggggagtacggccgcaaggttgaaactcaaaggaattgacgggggcccgcacaagcggtggagcatgtggtttaattcaaagcaacgcgcagaaccttaccagctcttgacatgggtaggaccgacgcagagatgcgtttttcccgcaagggacctaccgcacaggtgctgcatggctgtcgtcagctcgtgtcgtgagatgttgggttaagtcccgcaacgagcgcaaccctcgcctttagttgccagcatgtttgggtgggcactctaaaggaactgccggtgacaagccggaggaaggtggggatgacgtcaagtcctcatggcccttatgggctgggctacacacgtgctacaatggcggtgacaatgggaagccaggcagcgatgtcgagccgatcccaaaaagccgtctcagttcagatcgcagcctgcaactcggctgcgtgaaggtggaatcgctagtaatcgcggatcagcacgccgcggtgaatacgttcccgggccttgtacacaccgcccgtcacaccatgggagttggttttaccttaagcaggtgcgctaacccgcaagggaggtagcttgccacggtaggatcagtgactggggtgaagtcgtaacaaggtaac

SEQ ID NO: 24 - DNA, 693 bp, Enterobacter ludwigii
gtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtgaagctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggta

SEQ ID NO: 25 - DNA, 691 bp, Enterobacter sp.
atgctaggtgttgggggtttcaataccctcggtgccgaagttaacacattaagcatgccgcctggggagtacgctcgcaagagtgaaactcaaaggaattgacggggacccgcacaagcagtggagtatgtggtttaattcgaagcaacgcgaagaaccttaccaggtcttgacatcggaatgaccgcttcagagatggagctttccttcgggacattccagacaggtggtgcatggttgtcgtcagctcgtgtcgtgagatgttgggttaagtcccgcaacgagcgcaacccttgatcttagttgccagcatgtaaagatgggccctctaagatgactgccggtgacaaaccggaggaaggtagggatgacgtcaaatcatcatgccccttatgacctgggctacacacgtactacaatggccggtacaacggggagcgaaggagcgatctggagcaaatcctaataagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaacccgcaagggagccagccgccgaaggtggggtagatgattggggtgaagtcgtaacaaggtacc

SEQ ID NO: 26 - DNA, 687 bp, Escherichia coli
cgacttggaggttgtgtccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaggcggacttcataaagtatgtcgtagtccggattggagtctgcaactcgactccatgaggtcggaatcgctagtaatcgtggatcagaatgccacggtgaatacgttcccgggccttgtacacaccgcccgtcgcaccatgggagtgggttgcaaaagaagtaggtagcttaaccttcgggagggcgcttaccactttgtgattcatgactggggtgaagtcgtaacaaggtacc

SEQ ID NO: 27 - DNA, 688 bp, Escherichia coli
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttaacatccacggaattcggcagagatgccttagtgccttcgggaaccgtgagacaggtgctgcatggctgtcgtcagctcgtgttgtgaaatgttgggttaagtcccgcaacgagcgcaacccttatcctttgctgccagcgagtaatgtcgggaactcaaaggagactgccggtgataaaccggaggaaggtggggatgacgtcaagtcatcatggcccttacgagtagggctacacacgtgctacaatggcgcatacaaagagaagcgacctcgcgagaaaaagcggacctcacaaagtgcgtcgtagtccggatcggagtctgcaactcgactccgtgaagtcggaatcgctagtaatcgtggatcagaatgccacgatgaatacgttcccgggccttgtacacaccgcccgtcacaccatgttgtgggttgcaaaagaagtaggtagcttaacccttcgggagggcgcttaccactttgtgattcatgactggagtgaagtcgtaacaaggtaac

SEQ ID NO: 28 - DNA, 688 bp, Escherichia coli
cgacttggaggttgttcccttgaggagtggcttccggagctaacgcgttaagtcgaccgcctggggagtacggccgcaaggttaaaactcaaatgaattgacgggggcccgcacaagcggtggggcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttgtcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaagagaagtaggtagcttaaacttcgggagggcgcttaccactttgtgattcatgactggggtgaagtcgtaacaaggtatc

SEQ ID NO: 29 - DNA, 688 bp, Escherichia coli
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttgattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 30 - DNA, 687 bp, Escherichia coli
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcactcaccactttgtgattcatgactggggtgaagtcgtaacaaggtaga

SEQ ID NO: 31 - DNA, 687 bp, Escherichia coli
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 32 - DNA, 687 bp, Klebsiella pneumoniae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaggagaagcgacctcgcgagagcaagcggacctcacaaagtgcgtcgtagtccggatcggagtctgcaactcgactccgtgaagtcggaatcgctagtaatcgtggatcagaatgccacggtgaatgcgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 33 - DNA, 687 bp, Luteibacter sp.
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagacgtaacaaggtacc

SEQ ID NO: 34 - DNA, 687 bp, Methylobacterium sp.
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 35 - DNA, 686 bp, Paenibacillus caespitis
cgacttggaggttgtgcccttgaggcgcggcttccggagctaacgcgttaagtcgaccgtctggggagtacggtcgcaaggttaaaactcaaatgaattgacgggggcccgcacaagcggtggagcatgtggtttaattcgatgcaacgcggagaaccttacctggccttgacatccagagaacttagcagagatgctttggtgccttcgggaactctgagacaggtgctgcatggatgtcgtcagctcgtgttgtgaaatgttgggttaagtcccgcaacgagcgcaacccttatcctttgttgccagcgattcgttcgggaactcgaaggagactgccggtgacaaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattgaagtctgcaactcgactccatgaagtcggaatcgctagtactcttgaatcagaacctcacggtgaatacgttcccgggccttgtacacaccgcccgtcaccccatggagtggggtgctccacaagtagctagtctaaccctcggggagacggttaccacggagtgattcatgactggggtgaagtcgtaccaaggtaac

SEQ ID NO: 36 - DNA, 688 bp, Paenibacillus ruminocola
cgacttggaggttgttcccttgagaagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggctgagatgcctcagtgccttcgggaaccgtgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatggctggggtgaagtcgtaacaaggtaac

SEQ ID NO: 37 - DNA, 688 bp, Panteoa agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcaatgcaacgcgaagaaccttacctactcttggcatccagcgaattcggcagagatgcctcagtgccttcgggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggatctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 38 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaatgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccgggggaaggtggggatgacgtcaagtcatcatggcccttacgagtagggctacacacgtgctacaatggcgcatacaaagagaagcggcctcgcgagagtaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 39 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 40 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttggcagagatgccttggtgccttcgggaacgctgagacaggtgctgcgtggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagc

SEQ ID NO: 41 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcacgtggtttaattcgatgcaacgcgaagaaccttacctactcttgacatccagcgaacttggcagagatgccttggtgccttcgggaacgctgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagaacaagcggaccccacaaagtgcgtcgtagtccggatcgaagtctgcaactcgactccgtgaagtcggaatcgctagtaatcgtggatcagaatgccacggtgaacacgttcccgggccttgtacacaccgcccgtcacaccatgttgtgggttgcaaaagaagtaggtagcttaaccttcgggagggcgcttaccactttgtgattcatgactggagtgaagtcgtaacaaggtaac

SEQ ID NO: 42 - DNA, 687 bp, Pantoea agglomerans
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagaacaagcggacctcacaaagtgcgtcgtagtccggatcgaagtctgcaactcgactccgtgaagtcggaatcgctagtaatcgtggatcagaatgccacgatgaatacgctcccgggccttgtacacaccgcccgtcacaccatgttagtgggttgcaaaagaagtaggtagcttaaccttcgggagggcgcttaccactttgtgaatcatgactggagtgaagacgtaacaaggtaac

SEQ ID NO: 43 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgcggtttaattcgatgcaacgcgaagaaccttacctactcttgacatccagcgaacttggcagagatgccttggtgccttcgggaacgctgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatggcgtcaagtcatcatggcccttacgagtagggctacacacgtgctacaatggcgcatacaaagagaagcgacctcgcgagagcaagcggacctcacaaagtgcgtcgtagtccggatcggagtctgcagctcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 44 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 45 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 46 - DNA, 687 bp, Pantoea agglomerans
cgacttggaggttgttcccttgaggagtggcttccggagctaacgcgttaagtcgaccgcctggggagtacggccgcaaggttaaaactcaaatgaattggcgggggcccgcacaagcggtggagcatgtggtttaattcgatgcaacgcgaagaaccttacctactcttgacatccagagaacttagcagagatgctttggtgccttcgggaactctgagacaggtgctacatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccctgtacacaccgcccgtcacaccatgggagtgggttgcaaaagaagtaggtagcctaaccttcgggggggcgcttaccactttgtgattcatgactggggtgaagtcgtaacaaggtacc

SEQ ID NO: 47 - DNA, 687 bp, Pantoea agglomerans; identical to SEQ ID NO: 45

SEQ ID NO: 48 - DNA, 687 bp, Pantoea agglomerans; identical to SEQ ID NO: 39

SEQ ID NO: 49 - DNA, 677 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaatgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccgggggaaggtggggatgacgtcaagtcatcatggcccttacgagtagggctacacacgtgctacaatggcgcatacaaagagaagcggcctcgcgagagtaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgta

SEQ ID NO: 50 - DNA, 687 bp, Pantoea agglomerans
cgacttggaggttgttcccttgaggagtagcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcgaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgaccgatgactggggtgaagtcgtaacaaggtaac

SEQ ID NO: 51 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttggcagagatgccttggtgccttcgggaacgctgagacaggtgctgcatggctgtcgtcagctcgtgttgtgaaatgttgggttaagtcccgcaacgtgcgcaacccttatcctttgttgccagcacgtcatggtgggaactcaaaggagaccgccggtgataaaccggaggaaggtggggatgacgtcaagtcatcatggcccttacgagtagggctacacacgtgctacaatggcgcatacaaagagaagcgacctcgcgagagcgagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 52 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttggcagagatgccttggtgccttcgggaacgctgggacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaacttgactccgtgaagtcggaatcgctagtaatcgtggatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 53 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgagaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatctgaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 54 - DNA, 665 bp, Pantoea agglomerans
cgacttgaaggttgtgcccttgaggagctgtttcctgactaacgcgttaagtcgaccgcctggggagtacggccgcaaggttaaaactcaaatgaattggcgggggcccgcacaagcggtggagcatgtggtttaattcgatgcaacggaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactgggg

SEQ ID NO: 55 - DNA, 687 bp, Pantoea agglomerans
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaacctcacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgcgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 56 - DNA, 684 bp, Pantoea agglomerans
cgacttggaggttgttcccttgaggagtggcttccgggactaacgcgttaagtcgaccgcctggggagtacggccgcaaggttaaaactcaaatgaattgacgggggccgcacaagcggtggagcatgtggtttaattcgatgcaacgcgaagaaccttacctactcttgacatccacggaattcggcagagatgccttagtggcttcgggaaccgtgagacaggtgctgcatggctgtcgtcagctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgatccgtgaagtcggaatcgctagtaatcgtggatcagaatgccacggtgaatacgttcccgggccttgtacacaccgcccgtcacaccatgggagtgggttgcaaaagaagtaggtagcttaacttcgggagggcgcttaccactttgtgattcatgactggggtgaagtcgtaacaaggtacc

SEQ ID NO: 57 - DNA, 666 bp, Pantoea agglomerans
cgacttgaaggttgtgcccttgaggcgtgtgttccggggctaacgcgttaagtcgaccgcctggggagtacggccgcaaggttaaaactcaaatgaattgacgggggcccgcacaagcggtggagcatgtggtttagttcgatgcaacggaagaaccttacctactcttgacatccacggaattcggcagagatgcctcagtgccttcgggaaccgtgagacaggtgctgcatggctgtcgtcggctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagggcgtcgtagtccggatcggagtctgcaactcgactccgtgaagtcggaatcgctagtaatcgtggatcagaatgccacggtgaatacgttcccgggccttgtacacaccgcccgtcacaccatggagtgggttgcaaaagaagtagggagcttaaccttcgggagggcccttaccactttgggattcttgactggggg

SEQ ID NO: 58 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcgtgtggtttaattcgatgcaacgcgaagaaccttacctactcttgacatccagcgaacttggcagagatgccttggtgccttcgggaacgctgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtgggggtgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccgctttgtgattcatgactggggtgaagtcgtaacatggtacc

SEQ ID NO: 59 - DNA, 690 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactctcgacatccagcgaacttggcagagatgccttggtgccttcgggaacgctgagacaggtgctgcatggctgtcgtcagctcgtgctgtgaaatgttgggttaagtcccgcaacgagcgcaacccttatcctttgttgccagcacgtcatgttggtaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgcctcggtgaatacgtttcccgggccttgtacacaccgcccgtcacaccatggagtgggttgcaaaagaagtaggtagcttaaccttcgggagggcgctttaccactttgtgattcgggactggggtggaagtcgtaatcaaggacc

SEQ ID NO: 60 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttggcagagatgccctggtgccttcgggaacgctgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgagaagtcggaatcgctagtaatcgtggatcggaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 61 - DNA, 687 bp, Pantoea agglomerans; identical to SEQ ID NO: 34

SEQ ID NO: 62 - DNA, 687 bp, Pantoea agglomerans
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 63 - DNA, 686 bp, Pantoea agglomerans
cgacttggaggttgttcccttgaggagtggcttccggagctaacgcgttaagtcgaccgcccggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtac

SEQ ID NO: 64 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagc

SEQ ID NO: 65 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgttgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctctgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggggtgggttgcaaaagaggtaggtagcttaaccttcgggagggcgcttaccactttgtgattcatgactggggtgaagtcgtaacaaggtacc

SEQ ID NO: 66 - DNA, 629 bp, Pantoea agglomerans
ccgcctggggagtacggtcgcaagaccgaaactcaaaggaattgacaggggcccgcacaagcggtggagcatgtggtttaattcgatgcaacgcgaagaaccttacctactcttgacatccacggaattcggcagagatgccttagtgccttcgggaaccgtgagacaggtgctgcgtggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaaatacgtttcccgggccttgtacacaccgcccgtcacaccatgggagttggttgcaaaagaagtaggtagcttaaccttcgggagggcgcttaccactttgtgattcatgactggggtgaagtcgtaacaag

SEQ ID NO: 67 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggaacgtgtggtttaattcgatgcaacgcgaagaaccttacctactcttgacatccacggaactcggcagagatgccttagtgccttcgggaaccgtgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggactcacaaagtgcgtcgtagtccggatcggagtctgcaactcgactccgtgaagtcggaatcgctagtaatcgtggatcagaatgccacggtgaatacgtccccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 68 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgtcgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggagaagtcgtaacaaggtatc

SEQ ID NO: 69 - DNA, 687 bp, Pantoea agglomerans
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 70 - DNA, 687 bp, Pantoea agglomerans
cgacttggaggttgttcccttgaggagtggcttcccgagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 71 - DNA, 687 bp, Pantoea agglomerans; identical to SEQ ID NO: 45

SEQ ID NO: 72 - DNA, 687 bp, Pantoea agglomerans; identical to SEQ ID NO: 44

SEQ ID NO: 73 - DNA, 687 bp, Pantoea agglomerans; identical to SEQ ID NO: 46

SEQ ID NO: 74 - DNA, 687 bp, Pantoea agglomerans; identical to SEQ ID NO: 70

SEQ ID NO: 75 - DNA, 687 bp, Pantoea agglomerans
cgacttggaggttgttcccttgaggagtggcttccggagctaacgcgataagtcgaccgcctggggagtacggccgcaaggttaaatctcaaatgaattgacgggggcccgcacaagcggtggagcatgtggtttaattagatgcaacgagaagaaccttacgtactcttgacatccagagaacttagcagagatgctttggtgctttcgggatctatgagacaggtgccgcatggctgttgtcagctcgtgttgtgaaatgttgggttaagtcccgcaacgagcgcaacccttatcctttgttcccagcgattcggtcgggaattcaaaggagactgccggtgataaaccggaggaaggtggggaggacgtcaagtcatcatggcccttacgagtagggctccccacgtgttccaatggagcatccaaagagaagcgacctcgcgagagtaagcggtcctcgcaaagtgcgtcctcgtccggatcggattctgcaattggactccgggaattcggaatcgttagcaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 76 - DNA, 687 bp, Pantoea agglomerans
cgacttggaggttgttcccttgaggagtggcttccggagctaacgcgttaagtcgaccgcctggggagtacggccgcaagcctaaaactcaaatgaattgacgggtgcccgcacaagcgatggagcatgtggtttaattcgatgcaacgctaagaaccttacctactcttgacatccagagaacttagcagagatgctttggtgccttcgggaactctgagacaggtgctgcatggatgtcgtcagcccgggttgtgaaatgttgggttaggtcccgcaacgagcgcaacccttatcctttgttgccagcgattcgttcgggaactcgaaggagactgccggtgataaaccgaaggaagggggggatgacgtcaagtcatcatggcccttacggccagggctacacacgtgctacaatggcgcatacaaagagaagcgacctcgcgagagcaagcggacctcataaagtgcgtcgtagtccggatcgaagtctgcaactcgactccgtgaagtcggaatcgctagtactcgtggatcagaatgccacgttaatacgttcccgggccttgtacacaccgccccgtcacaccatgagagtgcgttgcaaaagaagtaggtagcttaaccttcaggaggccgcttaccactttgtgattcatgactggagcgaagtcgtaacaaggtacc

SEQ ID NO: 77 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 78 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacccttcgggagggcgcttaccactttgtgattcatgaccggggtgaagtcgtaacaaggtacc

SEQ ID NO: 79 - DNA, 674 bp, Pantoea agglomerans
cgacttggaggttgttcccttgaggagtggcttccggagctaacgcgttaagtcgaccgcctggggagtacggccgcaaggttaaaactcgaatgaattgacgggggcccgcacaagcggtggagcatgtggtttaattcgatgcaacgcgaagaaccttacctactcttgacatccagagaacttagcagagatgctttggtgccttcgggagctctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 80 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgcggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcacatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgaccgatgactggggtgaagtcgtaacaaggtaac

SEQ ID NO: 81 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctggaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 82 - DNA, 685 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtccgcaactcgactccgtgaagtcggaatcgctagtaatcgcggatcagaatgccacggtgaatacgttcccgggccttgtacacaccgcccgtcacaccatggagtgggttgcaaaagaagtaggtagcttaaccttcgggagggcgcttaccactttgtgattcatgactgggtgaagtcgtaacaaggtacc

SEQ ID NO: 83 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 84 - DNA, 687 bp, Pantoea agglomerans; identical to SEQ ID NO: 81

SEQ ID NO: 85 - DNA, 686 bp, Pantoea agglomerans
cgacttggaggttgttcccttgaggagtggcttccggagctaacgcgttaagtcgaccgcctggggagtacggccgcaagcctaaaactcaaatgaattgacgggtgcccgcacaagcgatggagcatgtggattaattcgatgcgacgtgaagaaccttacctactcttgacatccagagaacttagcagagatgctttggtgccttcgggaactctgagacaggtgctgcatggatgtcgtcagctcgtgttgtgaaatgttgggttaagtcccgcaacgagcgcaacccttatcctttgttgcgagcgattcgttcgggaactcgaaggagactgccggtgataaaccgaaggaaggtggggatgacgtcaagtcatcatggcccttacgagtagggctacacacgtgctacaatggcgcatacaaagagaagcgacctcgcgagagtaagcggacctcactaagtgcgtcgtagtccggatcggagtctgcaactcgactccgtgaagtcggaatcgctagcaatcgtggatcagaatgccacgttgaatacgttcccgggccttgtacacaccgcccgtcacaccatggagtgcgttgcaaaacaagaaggtagcttaaccttcaggaggtcgcttaccactttgtgattcatgactggggcgaggtcgtaacaagggacc

SEQ ID NO: 86 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttggcatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 87 - DNA, 690 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcctgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagttgggttgcaaaagaagtaggtagcttaaccttcgggagggcgcttaccactttgtgatttcatgactggggtgaagtcgtaacaaggtacc

SEQ ID NO: 88 - DNA, 686 bp, Pantoea ananatis
cgacttggaggttgttcccttgaggagtggcttccggagctaacgcgttaagtcgaccgcctggggagtacggccgcaaggctaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcggagggcgcttaccactttgtgattcatgactggggtgaagtcgtaacaaggtacc

SEQ ID NO: 89 - DNA, 687 bp, Pantoea ananatis
cgacttggaggttgttcccttgaggagtggcttccggagctaacgcgttaagtcgaccgcccggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 90 - DNA, 687 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaagggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaacccgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 91 - DNA, 688 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggttttaattcgatgcaacgcgaagaaccttacctactcttgacatccagagaactttccagagatggattggtgccttcgggaactctgagacaggtgctgtatggctgtcgtcagctcgtgttgtgaaatgttgggttaagtcccgcaacgagcgcaacccttatcctttgttgccagcgattcggtcgggaactcaaaggagactgccggtgataaaccggaggaaggtggagatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccacttcgtgattcatgactggggtgaagtcgtaacaaggtaac

SEQ ID NO: 92 - DNA, 687 bp, Pantoea ananatis; identical to SEQ ID NO: 89

SEQ ID NO: 93 - DNA, 687 bp, Pantoea ananatis; identical to SEQ ID NO: 90

SEQ ID NO: 94 - DNA, 687 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 95 - DNA, 687 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaaaaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 96 - DNA, 686 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgcctccgggaactctgagacaggtgctgcatggctgtcgtcagctcgtgttgtgaaatgttgggttaagttccgcaacgagcgcaacccttttcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagggcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcggagggcgcttgccactttgtgattcatgactggggtgaagtcgtaacaaggtacc

SEQ ID NO: 97 - DNA, 687 bp, Pantoea ananatis
caactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatggactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtggatcagaatgccacggtgaatacgttcccgggccttgtacacaccgcccgtcacaccatgggagtgggttgcaaaagaagtaggtagcttaaccttcaggagggcgcttaccactttgtgattcatgactggggtgaagtcgtaacaaggtatc

SEQ ID NO: 98 - DNA, 688 bp, Pantoea sp.
caactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacataatggtgggcactctaaggagactgccggtgacaaaccggaggaaggtggggatgacgtcatgtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctagccttcgggaggacggttaccacggagtgaccgatgactggggtgaagtcgtaacaaggtaac

SEQ ID NO: 99 - DNA, 688 bp, Pantoea sp.
caactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaagagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttaccacggagtgattcatgactggggtgaagtcgtaacaaggtaac

SEQ ID NO: 100 - DNA, 690 bp, Pantoea sp.
cgaactggatgttgggagcaatttggcacgcagtatcgaagctaacgcgttaagttcgccgcctggggagtacggtcgcaagactgaaactcaaaggaattgacggggggctgcacaagcggtggagtatgtggtttaattcgatgcaacgcgaagaacctttcctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtttgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgtcacggtgtggccgatgactggggtgaagtcgtaacaaggtaac

SEQ ID NO: 101 - DNA, 688 bp, Pantoea sp.
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgacgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagcgggcgacggtaagccaatcccagaaaccctatctcagtccgaattggagtctgcaactcgactccatgaagtcggaatcgctagcaatcgcagatcagcattgctgcgatgaatacgttcccgggccttgtacacaccgcccgtcacaccatgggagtttgttgcaccagaagcaggtagcttaaccttcgggaggccgctcgccacggtgtggtcgatgactgggtgaagtcgtaacaaggtacc

SEQ ID NO: 102 - DNA, 688 bp, Pantoea sp.
agaagtgaggttgggtgcgatttggcacgcagtttcgaagctaacgcgttaagttcgccgcgtgggggagtacggtcgcaaggctgaaactcaaaggaattgacgggggtccgcacaagcggtggagtatgtggtttaattcgatgcaacgcgaagaaccttacctggccctgacatgtcgagaactttccagagatggttggtgccttcgggaactcgaacacaggtgctgcatggctgtcgtcagctcgtgtcgtgagatgttgggttaagtcccgcaacgagtgcaacccttgtccttagttgccggcacgtaatggtgggaactctaaggagaccgccggtgacaaaccggaggaaggtggggatgacgtcaggtcatcatggcccttacggccagggctacgcgcgtactacaatggtagggacagagggttgcaagccggcgacggtaagtcaatcccagaaaccctatctcagtccggattggagtctgcaactcgactccatgaagtcggaatcgttagtaatcgcagatcagcattgctgcggtgaatacgttcccgggccttgtacacaccgcccgtcacgccatgggagtttgttgcaccagaagcaggtagctcaccttcgcgagggcgctttccacggtgtggccgatgactggggtgaagtcgtaacaaggtcc

SEQ ID NO: 103 - DNA, 691 bp, Pantoea sp.
  misc_feature 330: N is A,T,C or G
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgccagctcgtgtcgtgagatgttgggttaagttccgcaacgagcgcaacccttgtccttagttgccagcacgtaatggtgggaactntaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtacc

SEQ ID NO: 104 - DNA, 690 bp, Pantoea sp.
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgccagctcgtgtcgtgagatgttgggttaagttccgcaacgagcgcaacccttgtccttagttgccagcacgtaatggtgggaactttaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtttgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtac

SEQ ID NO: 105 - DNA, 691 bp, Pantoea sp.
cgaactgaatgttgggtgcgatttggcacgcagcatcgaggctaacgcgttaagttcgccgcctggggagtacggacgccagcctgaaactcatacgaattgacgagggcccgcacgagcgattgaggatgtggattaattcgatgcaacgagaagaatcttatctggccttgacatgtcgagaactttccagatatggattggtgccttcgggaactcgaacacaggtgctgcatgaatgtcgtcagctctggtcgtgagatgctggcttaagtcccgcaacgagcgcaacccttgtccttagttgcgagcacgtcatgagggtaactctaaggagaccgcgggtgacaaaccgaaggaaggtgcggatgacgtcaagtcatcatggcccttacggccagggctacacacgtcctacaatgataggtacacaggtccgcaagcgggcgacgctaagccaatcaaggaaaccatatctcagtccggattgaagtccgcaactcgactccatgaagtccgaatcactagaactctcagatcagcatcgctgcggtgcatacattcccggtccttggacacaccgcccgtcacgccatggtaatttggtgtaccacaagcaggtagcttaaccttcgggagggcgcttgctacgatgtgtcggaggactggggcgcagtcgtaacaaggcacc

SEQ ID NO: 106 - DNA, 690 bp, Pantoea sp.
cgaactggatgttgggtgcaatttggcacgcagcatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttggcttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatggagtttgttgcaccagaagcaggtagcttaaccttcgggagggcgcttgctacggtgtggccgatgactggggtgaagtcgtaacaaggtaac

SEQ ID NO: 107 - DNA, 690 bp, Pantoea sp.
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtgccgatgactggggtgaagtcgtaacaaggtatc

SEQ ID NO: 108 - DNA, 691 bp, Pseudomonas fluorescens
cgaactggatgttgggtgcaatttggcacgcagtatcgaagctaacgcgttaagttcgccgcctggggagtacggtcgcaagactgaaactcaaaggaattgacggggggccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtacc

SEQ ID NO: 109 - DNA, 691 bp, Pseudomonas oleovarans
cgaactggatgttgggtgcaatttggcacgcagtatcaaagccaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtatc

SEQ ID NO: 110 - DNA, 691 bp, Pseudomonas oryzihabitans
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgatggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtgcccgatgactggggtgaagtcgtaacaaggtacc

SEQ ID NO: 111 - DNA, 691 bp, Strenotrophomonas maltophilia
cgaactggatgttgggtgcaatttggcacgcagtatcgaagctaacgcgttaagttcgccgcctggggagtacggtcgcaaggctgaaactcaaaggaattgactggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtggcaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtatc

SEQ ID NO: 112 - DNA, 691 bp, Strenotrophomonas maltophilia
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgccagctcgtgtcgtgagatgttgggttaagttccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtacc

SEQ ID NO: 113 - DNA, 689 bp, Strenotrophomonas maltophilia
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgacgcaacgggaagaaccttacctggccttgacatgtcgagaactttccagagatggattggtgccttcgggaactcgaacacaggtgctgcatggctgtcgtcagctcgggtcgtgagatgttgggttaagtcccgcaacgagcgcaacccttgtccttagttgccagcacgtcatgggggtaactctaaggagaccgcgggtgacaaaccgaagaaaggggcggatgacgtcaagtcatcatggcccttacggccagggctacacacgtcctacaatggtaggtacagagggctgcaagccggcgacgctaagccaatcaaagaaaccctatctcagtccggattgaagtctgcaactcgactccatgaagtcggaatcgctagaactcgcagatcagcattcgctgcggtgaatacgttcccggtcctggtacacaccgcccgtcacaccatggaagtttgttgcaccagaagaaggtagcttaaccttcggggagggcgcttgccacggtgtggcgaggactggggagagtcgtaccaggtat

SEQ ID NO: 114 - DNA, 691 bp, Strenotrophomonas maltophilia
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagcctgcaacttgactccatgaagtcggaatcgctagtaatcgcagatcagcattgctgcggtgaatacgttcccgggccttgtacacaccgcccgtcacaccatgggagtttgttgcaccagaagcaggtagcttgaccttcgggagggcgcttgccacggtgtggccgatgactggggtgaagtcgtaacaaggtacc

SEQ ID NO: 115 - DNA, 691 bp, Strenotrophomonas maltophilia
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatggcgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccataggagtttgttgcaccagaagcaggtagcttaaccttcgggagggcgcttgccacggtgtggccgatgactggggtgaagtcgtaacaaggtacc

SEQ ID NO: 116 - DNA, 683 bp, Strenotrophomonas maltophilia
cagctgattgttcgggaagcaattcctgggtaaccaagccaacgcgtgaagctgaccgcctgggaagtacggtcgcaagattaaaactcaaaggaattgacggggacccgcacaagcggtggatgatgtggattaattcgacgcaacgcgaaaaaccttacctagccttgacatgtcaggaacccggatgaaagtctggagtgcccgcaagggagcctgaacacaggtgctgcatggctgtcgtcagctcgtgtcgtgagatgttgggctaagtcccgcaacgagcgcaaccctagtcatcagttgctacgcaagagcactctgatgagaccgccggtgacaaaccggaggaagatggggatgacgtcaagtcctcatggcccttacggctaggacctcacacgtcatataatggtcggaacagagggcagcgaagccgggaggcggagctaatcccagaaaaccgatcgtagtccggattgcagtctgcaactcgactgcatgaagtcggaatcgctagtaatcgcggatcagcatgccgcggtgaatacgtttcccggttcttgtacacaccgcccgtcacaccatgggagtggggtttgccagaaggcgtttgtccaaccgcaaggaggacggcgaccacggtgggttcaatgactggggcgaagtcgtaacaaggtatc

SEQ ID NO: 117 - DNA, 657 bp, Strenotrophomonas maltophilia
ggatttggggagtatcgaccctctccgagtcgaagctaacgcgttaagcgatccgcctgggtagtacggccgcaaggataaaactcaaaggaatagacggggacttgcacaagcggtggagcgtgtggcttaattcgtcgctaaccgaagaaccttaccaaggctagaaatgctactgcacgcccagcgaaagctgggaagccttcgagggtgtagcacaggtgatgcacggctgtcgtcagttcgtggtttgaatcgttcccttcagtggggtaacgaacgcaaccctcgttgcctgttatatatgtcaggcgagactgccccctcacgggggaggaaggtgaggatgacgccaagtcagcgtgtccctctgatgtcttgagctgcacacgcgctacaatcgccgttacaaaggggcgcaatggggtaacccggagcaaatcccaaaaagcggcgccggttcggattgaggtctgcaacccgacctcatgaagccggaatcgctagtaatcgtgggtcagccacaccacggtgaatacgttctcaagtcttgtactcacagcccgtcaactcaggaaagttggaagtgcccgaagtcaatcctcgtgattgcccaaggcaaactcaataacaaagagtaagtcgtaacaaggtaac

SEQ ID NO: 118 - DNA, 656 bp, Strenotrophomonas maltophilia
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattctgcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 119 - DNA, 658 bp, Strenotrophomonas maltophilia
tccccgggatctgtgccgtagctaacgcattaagcgccccgcctgggagtacggccgcaaggttaaactcaaaggaattgacgggggcccgcacaagcgcggagatgtggattaattcgatgcaacgcgaagaaccttacctggttttgacatacaccggaaaaccgtagagatacggccccccttgtggccggtgtacaggtggggcatgtttgtcgtcagctcgggtcgggagatgttgggttaggtcccgcaacgagcgcaacccttgtcttatgttgccagcacgtaatgttggggactcgtaagagattgccgggttcaactcgaaggaaggtggggacgacgtcaagtcatcttgccccttatgtccagggcttcacacatgctacaatggccagtacagagggctgcgagaccgtggaggggaagcgaatcccttaaagctggtctcagttcggatcggggtctgcaactcgaccccgtgaagtcggagtcgctagtaatcgcagatcagcaacgctgcggtgaatacgttcccgggccttgtacacaccgccccgtcacgtcatgaaagtcgtaacacccgaagccgggtggcctaaccccttgtgggagggagccgtcgaaaggtggtatcggcgattgggacgaatct

SEQ ID NO: 120 - DNA, 654 bp, Strenotrophomonas maltophilia
tgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttaccacggagtgattcatgactggggtgaagt

SEQ ID NO: 121 - DNA, 656 bp, Strenotrophomonas maltophilia
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 122 - DNA, 652 bp, Strenotrophomonas maltophilia
actgagggtggattccggagctaacgcgttaagtcgaccgcctggggagtacggccgcaagttaaaactcaaatgaattgacgggggcccgcacaaggagggagcatgtggtttaattcgatgcaacggaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagacctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 123 - DNA, 654 bp, Strenotrophomonas maltophilia
gcttgcaccgcagtagcgcagctacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtc

SEQ ID NO: 124 - DNA, 450 bp, Strenotrophomonas maltophilia
cttgaggcgagccttctggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaag

SEQ ID NO: 125 - DNA, 656 bp, Strenotrophomonas maltophilia
cttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 126 - DNA, 656 bp, Strenotrophomonas maltophilia; identical to SEQ ID NO: 125

SEQ ID NO: 127 - DNA, 656 bp, Unknown; identical to SEQ ID NO: 125
  Uncultured seed derived bacterium of the family Enterobacteriaceae

SEQ ID NO: 128 - DNA, 620 bp, Unknown
  Uncultured seed derived bacterium of the family Sphingomonadaceae
cttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacgcgctgggctacacacgtgctacaatggcggtgacagtgggcagcaatcccgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggca

SEQ ID NO: 129 - DNA, 656 bp, Pantoea agglomerans; identical to SEQ ID NO: 125

SEQ ID NO: 130 - DNA, 394 bp, Rhodococcus fascians
aatgttgggtttaagtccccgccaacgagcgcaaacccttatccttttgttgcccagcggttaggcccgggaactcaaaggagactgccagtgataaactggaggaaggtggggatgacgtcaagtcatcatggcccttacgaccagggctacacacgtgctacaatggcgcatacaaagagaagcaatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcggagggcgctaccac

SEQ ID NO: 131 - DNA, 642 bp, Pseudomonas oryzihabitans
atttccttagtaacgtagctaacgcgtgaagttgaccgcctggggagtacggtcgcaagattaaaactcaaaggaattgacggggacccgcacaacgtggatgatgtggattaattcgatgcaacggaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggagaaggtggggatgacgtcaagtcctcatggcccttatgggtagggcttcacacgtcatacaatggtcggaacagagggtcgccaacccgcgagggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaagaggacggtcaccacggtaggattcatgactggggtgaagtc

SEQ ID NO: 132 - DNA, 656 bp, Pantoea agglomerans
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 133 - DNA, 654 bp, Escherichia coli; identical to SEQ ID NO: 123

SEQ ID NO: 134 - DNA, 657 bp, Methylobacterium radiotolerans
cacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggtttcccctttggggcgggttcacaggtggtgcatggttgtcgtcagctcgtgtcgtgagatgttgggttaagtcccgcaacgagcgcaaccctcgttccatgttgccagcacgtcgtggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcctaacccttgtggggggagccgtcgaaggtgggaccagcgattgggactaagtc

SEQ ID NO: 135 - DNA, 646 bp, Escherichia coli
attgacttggtaacgtagctaacgcgtgaagttgaccgcctggggagtacggtcgcaagattaaaactcaaaggaattgacggggacccgcacaaggggggatgatgtggattaattcgatgcaacggaaaaaccttacctacccttgacatgtatggaatcctgctgagaggtgggagtgcccgaaagcaagccataacacaggtgctgcatggctgtcgtcagctcgtgtcgtgagatgttgggttaagtcccgcaacgagcgcaacccttgtccctagttgctacgcagagcactctagggagactgccggtgacaaaccggaggaaggtggggatgacgtcaagtcctcatggcccttatgggtagggcttcacacgtcatacaatggtcggaacagagggtcgccaacccgcgaggggccgccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaagagggacggtcaccacggtaggattcatgactggggtgaagtc

SEQ ID NO: 136 - DNA, 651 bp, Enterobacter sp.
tctgccccttagttctgcagtaacgcattaagcactccgcctgggagtacgaccgcaaggtgaaactcaaaggaattgacggggacccgcacaagcgggaagcatgtggtttaattcgaagcaacgggagaaccttaccaaatcttgacatcctttgaccgctctagagatagagtcttccccttcggggtacaaagtgacaggtggtgcatggttgtcgtcagctcgtgtcgtgagatgttgggttaagtcccgcaacgagcgccacccttaagcttagttgccatcattaagttgggcactctaagttgactgccggtgacaaaccgtaggaagggggggatgacgtcaaatcatcatgccccttatgatttgggctacacacgtgctacaatggacaatacacagggcagctaaaccgcgagtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattgggtgaagtc

SEQ ID NO: 137 - DNA, 509 bp, Enterobacter sp.
gttaattgatccccttggggagtccggccccaaggttaaaattcaaaggaatggacgggggccggcccaagcggtggaccatggggtttaattggaggcaacgggaggacccttaccggctttggccatcaacggacgtttccgggaaggatttgtgcctttggggacattgggaccagaggtgcaaggctgttgtcatcttgtgttgtgggaagatggggtaaattccctcacgagggccacccctttccttatttaccaacatgttatggtgggcactctaaggagactgccggtgacaaaccggaggaaggtggggatgacgtcaagtcatcatggcccttacggcctgggctacacacgtgctacaatggtcggtacaaagggaagccaatccggagatcgagctaatttcataaaagcgatcgtagtccggatcgcagtctgcaactcgaatccgtgaagtcggaatcgttagtaacgcgaatcagaatgttcggtgaatacgt

SEQ ID NO: 138 - DNA, 656 bp, Enterobacter sp.
cttgaggcgtggcttccggagctaacgcgttaaatcgaccccctggggagtacggccgcaaggttaaaactcaaatgaattgacgggggcccgcacaagcggtggagcatgtggtttaattcgatgcaacgcgaagaaccttacctggtcttgacatccacagaacttaccagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 139 - DNA, 533 bp, Sphingomonas sp.
gcatgtggttaattcgagcacggagaacttaccatcctttgacatggcgtgttatgggggagagattcccagtcctcttcggagcgcgcacacaggtgctgcatggctgtcgtcagctcgtgtcgtgagatgttgggtaagtcccgcaacgagcgcaacccacgtccttagttgccatcattcagtgggcactctagggagactgccggtgataagccgcgagaaggtgtggatgacgtcaagtcctcatggcccttacgggatgggctacacacgtgctacaatggcggtgacagtgggacgcgaaggggcgacctggagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacgcgctgcgcaaccgcaagagcaggcgaccacggtaggtcagcgactgggtgagtc

SEQ ID NO: 140 - DNA, 644 bp, Hafnia alvei
atttccttagtaacgtagctaacgcgtgaagttgaccgcctggggagtacggtcgcaagattaaaactcaaaggaattgacggggacccgcacaagcgtggatgatgtggattaattcgatgcaacggaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggggactgccggtgacaaaccggaggaaggtggggatgacgtcaagtcctcatggcccttatgggtagggcttcacacgtcatacaatggtcggaacagagggtcgccaacccgcgagggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaagaggacggtcaccacggtaggattcatgactggcgtgaagtc

SEQ ID NO: 141 - DNA, 656 bp, Escherichia coli
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttgccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagcaagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 142 - DNA, 650 bp, Burkholderia gladioli
tcagcccattagtgctgcagtaacgcattaagcactccgcctggggagtacgaccgcaagtgaaactcaaaggaattgacggggaccgcacaagcgtggagcatgtggtttaattcgaagcaacggtggaaccttaccaaatcttgacatcctctgactcctctagagttagagttttccccttcggtgcccttagtgacaggtggtgcatggttgtcgtcagctcgtgtcgtgagatgttggtttaagtcccgcaacgagcgcttcccttaagcttagttgccatcattaagttgggcactctaagttgactgccggtgacaaaccgaaggaaggtggggatgacgtcaaatcatcatgccctttatgatttgggctacacacgtgctacaatggacaatacacagggcagcgaaaccgcgagttcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggagtgaagtc

SEQ ID NO: 143 - DNA, 656 bp, Escherichia coli
tcggccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacgaagggtagcgaaaccgcgagttcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtc

SEQ ID NO: 144 - DNA, 655 bp, Methylobacterium radiotolerans
gcttgcacctcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttatggggagagattcccagtcctcttcggaggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggggcgacctggagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtc

SEQ ID NO: 145 - DNA, 611 bp, Micrococcus luteus
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgctaatcagaatgtcgcggtgaatacgttcccgggccttgtacacaccgcccgttacaccatggaagtgagttgcaccagaattagctagtctaacct

SEQ ID NO: 146 - DNA, 652 bp, Burkholderia phytofirmans
ttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtc

SEQ ID NO: 147 - DNA, 657 bp, Staphylococcus warneri
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtc

SEQ ID NO: 148 - DNA, 656 bp, Pseudomonas fluorescens
cttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtc

SEQ ID NO: 149 - DNA, 624 bp, Enterobacter cloacae
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcta

SEQ ID NO: 150 - DNA, 657 bp, Methylobacterium brachiatum
cttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 151 - DNA, 334 bp, Burkholderia gladioli
tcgaccgcctggggagtacggccgcaaggttaaaactcaaatgaattgacgggggcccgcacaagcggtggagcatgtggtttaattcgatgcaacgcgaagaaccttacctggccttgacatccagagaacttatcagagatgctttggtgccttcgggaactctgagacaggtgctgcaggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgacaagtcatcatggcc

SEQ ID NO: 152 - DNA, 657 bp, Escherichia coli
cttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatgcattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtaatccggattggagtctgcaactcgactccatgaagtcggaatcgctagtaatcgtagatcaaaatgctacggtgaatacgttcccgggccttgtacacaccgcccgtcacaccatgggagtgggttgcaaaagaagtaggtagcttaaccttcgggagggcgcttaccactttgtgattcatgactgggggtgaagtc

SEQ ID NO: 153 - DNA, 657 bp, Staphylococcus sp.; identical to SEQ ID NO: 147

SEQ ID NO: 154 - DNA, 657 bp, Staphylococcus epidermitis
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaaaaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtc

SEQ ID NO: 155 - DNA, 657 bp, Methylobacterium brachiatum
cttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccactgaattcggcagagatgccttggtgccttcgggaaccgtgagacaggtgctgcatggctgtcgtcagctcgtgttgtgaaatgttgggttaagtcccgcaacgagcgcaacccttatcctttgttgccagcgagtcatggcgggaactcaaaggagactgccggtgataaaccggaggaaggtggggatgacgtcaagtcatcatggcccttacgagtagggctacacacgtgctacaatggcgcatacaaagagaagcgacctcgcgagagcgagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 156 - DNA, 656 bp, Pseudomonas putida
cttgaggagtggcttccggagctaacgcgttaagtgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaataattaggtagcttaaccttcgggagggcgcttaccactttttgatttcatgactggggtgaattc

SEQ ID NO: 157 - DNA, 613 bp, Burkholderia phytofirmans
gaccgcctggggagtacggccgcaaggttaaaactcaaatgaattgacgggggcccgcacaagcggtggagcatgtggtttaattcgaagcaacgcgaagaaccttacctagtcttgacatccaatgaactttccagagatggattggtgccttcgggaacattgagacaggtgctgcatggctgtcgtcagctcgtgtcgtgagatgttgggttaagtcccggaacgagcgcaacccttgtccttagttaccggcacgtgatggtgggaactctaaggagactgccggtgacaaaccggaggaaggtggggatgacgtcaagtcatcatggcccttacgacctgggctacacacgtgctacaatggtcgatacaaagggttgccaccccgcgaggtggagctaatcccataaagcggatcgtagtccggatcgcagtctgcaactcgactgcgtgaagtcggaatcgctagtaatcgcgaatcagaatgccgcggtgaatacgttcccgggccttgtacacaccgcccgtcacaccatgggagtgggttgcaccagaagtagctagctctaaccttcgggaggacgcttaccactttgtgattcatgactgg

SEQ ID NO: 158 - DNA, 626 bp, Pseudomonas putida
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggtac

SEQ ID NO: 159 - DNA, 657 bp, Sphingomonas sp.; identical to SEQ ID NO: 150

SEQ ID NO: 160 - DNA, 657 bp, Pantoea agglomerans
cttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggataggtgccttcgggagctcagacacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttaccacggagtgattcatgactggggtgaagtc

SEQ ID NO: 161 - DNA, 657 bp, Pantoea agglomerans; identical to SEQ ID NO: 147

SEQ ID NO: 162 - DNA, 657 bp, Pantoea dispersa
cttgagcttttagtggcgcagctaacgcattaagttgaccgcctggggagtacggccgcaaggttaaaactcaaatgaattgccgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgttcacaccgcccgtcacaccatgggagtgggttgcaccagaagtagctagtctaaccttcgggaggacggttaccacggtgtgattcatgactggggtgaagtc

SEQ ID NO: 163 - DNA, 481 bp, Enterobacter cloacae
cgcgaaaaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaagaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtctaccatgggagtgggttgcaaagaataggtagcttttccttc

SEQ ID NO: 164 - DNA, 654 bp, Pseudomonas putida
cttgaggagtggcttccggagctaacgcgttaagtcgaccgcctggggagtacggccgcaagtttaaaactcaaatgaattgacgggggcccgcacaagcgtggagcatgtggtttaattcgatgcaacggaagaaccttacctactcttgacatccacggaattcggcagagatgccttagtgccttcgggaaccgtgagacaggtgctgcatgctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 165 - DNA, 617 bp, Pseudomonas putida
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactttgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacctcgggagg

SEQ ID NO: 166 - DNA, 464 bp, Pantoea agglomerans
cttgaggcgtgcttctggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggggggatgacgtcaagtcatcatggcccttacgagtagggctacacacgtgctacaatggcgcatacaaagagaagcgacctcgcgagagcaagcggacctcataaagtgcgtcgtagtccgga

SEQ ID NO: 167 - DNA, 655 bp, Pantoea agglomerans
gcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtc

SEQ ID NO: 168 - DNA, 618 bp, Pseudomonas putida
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagg

SEQ ID NO: 169 - DNA, 657 bp, Pseudomonas tolaasii; identical to SEQ ID NO: 147

SEQ ID NO: 170 - DNA, 656 bp, Pantoea agglomerans
cccacgagttccgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggcgattgggactaagtc

SEQ ID NO: 171 - DNA, 657 bp, Pseudomonas oryzihabitans
tccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggatcgccgcagaaatgtggtttcccctttggggccggttcacaggtggtgcatggttgtcgtcagctcgtgtcgtgagatgttgggttaagtcccgcaacgagcgcaaccctcgttctatgttgccagcgcgtgatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttgtaacacccgaagccggtgcctaaccccttgtggagggagctgtcgaaggtgggactggcgattggactaagtc

SEQ ID NO: 172 - DNA, 653 bp, Pseudomonas putida
ccgagttccgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggcgattgggactaagtc

SEQ ID NO: 173 - DNA, 456 bp, Pseudomonas putida
gagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 174 - DNA, 656 bp, Pantoea agglomerans
cttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 175 - DNA, 657 bp, Pantoea agglomerans; identical to SEQ ID NO: 171

SEQ ID NO: 176 - DNA, 603 bp, Enterobacter asburiae
gccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcgtggctgtcgtcagctcgtgttgtgaaatgttgggttaagtcccgcaacgagcgcaccccttatcctttgttgccagcggtccggccgggaactctaaggagactgccagtgataaactgaaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccttgaagtcggaatcgctagtaatcgtagatcacaatgctacggtgaatacgttcccgggccttgtacacaccgcccgtcacaccatgggagtgggttgcaaaagaagtaggtggcttaaccttcgggagggcgcttaccactttgtgattcatgactgtgggtgaagtc

SEQ ID NO: 177 - DNA, 656 bp, Enterobacter asburiae
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 178 - DNA, 654 bp, Methylobacterium radiotolerans
ccttgagcgtggttccggagctaacgcgttaagtcgaccgcctggggagtacggccgcaaggttaaaactcaaatgaattgacgggggcccgcacaagcgtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagaccaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 179 - DNA, 656 bp, Pantoea dispersa
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 180 - DNA, 360 bp, Pseudomonas putida
cggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 181 - DNA, 657 bp, Cellulomonas denverensis
tttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtc

SEQ ID NO: 182 - DNA, 657 bp, Arthrobacter ramosus
ttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccgatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactgggggtgaagtc

SEQ ID NO: 183 - DNA, 656 bp, Cellulomonas denverensis
cttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 184 - DNA, 656 bp, Pantoea ananatis
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttacccctttgtgattcatgactggggtgaagtc

SEQ ID NO: 185 - DNA, 663 bp, Pantoea ananatis
tcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtggagctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtc

SEQ ID NO: 186 - DNA, 632 bp, Arthrobacter sp.
tcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtgaagctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgc

SEQ ID NO: 187 - DNA, 659 bp, Enterobacter asburiae
tcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgaccggtctagagataggcctttccttcgggacaggggagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaaggagcgatctggagcgaatctttagaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagacgattggggtgaagtc

SEQ ID NO: 188 - DNA, 387 bp, Enterobacter cloaceae
gcgatacccttggtgccgaagttaacacattaagcattccgcctggggagtacgggcgcaagactgaaactcaaaggaattgacggggacccgcacaagcagtggagtatgtggtttaattcgaagcaacgcgaagaaccttaccaggtcttgacatccccctgaccggtctagagataggcctttccttcgggacaggggagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctac

SEQ ID NO: 189 - DNA, 656 bp, Enterobacter hormaechei
tccacgagttccgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggcgattgggactaagtc

SEQ ID NO: 190 - DNA, 657 bp, Pantoea dispersa
ccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgctgcagaaatgtagaactctttggacactcgtatacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtc

SEQ ID NO: 191 - DNA, 663 bp, Enterobacter cloacae
tcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtgaagctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtc

SEQ ID NO: 192 - DNA, 663 bp, Stenotrophomonas maltophilia; identical to SEQ ID NO: 191

SEQ ID NO: 193 - DNA, 656 bp, Stenotrophomonas maltophilia
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaaagt

SEQ ID NO: 194 - DNA, 658 bp, Klebsiella pneumoniae
tatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtc

SEQ ID NO: 195 - DNA, 656 bp, Citrobacter freundii; identical to SEQ ID NO: 121

SEQ ID NO: 196 - DNA, 656 bp, Paenibacillus caespitis; identical to SEQ ID NO: 121

SEQ ID NO: 197 - DNA, 657 bp, Paenibacillus graminis; identical to SEQ ID NO: 150

SEQ ID NO: 198 - DNA, 656 bp, Paenibacillus sp.
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 199 - DNA, 657 bp, Paenibacillus sp.
cttgagcttttagtggcgcagctaacgcattaagttgaccgcctgatgagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtc

SEQ ID NO: 200 - DNA, 496 bp, Cellulomonas denverensis
gcaacgcgaagaaaccttacctggccttgacatgcaatgaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcgcggtgaatacgttcccgggccttgtacacaccgcccgtcacaccatgggagtgggttgctccagaagtagctagtctaaccttcgggagga

SEQ ID NO: 201 - DNA, 656 bp, Microbacterium sp.; identical to SEQ ID NO: 121

SEQ ID NO: 202 - DNA, 657 bp, Paenibacillus caespitis
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtc

SEQ ID NO: 203 - DNA, 656 bp, Paenibacillus caespitis
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccataatgagttagtctaccttcgggaggacggttaccacagcgtgattcatgactggtgtgaagtc

SEQ ID NO: 204 - DNA, 657 bp, Enterobacter asburiae
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtc

SEQ ID NO: 205 - DNA, 477 bp, Rhizobium sp.
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggaacaaagggttgccaagccgcgaggtggagttaatcccataaaaccgatcgtactccggatcgcagctgc

SEQ ID NO: 206 - DNA, 657 bp, Pantoea agglomerans
cttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaattcggcagagatgccttagtgccttcgggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 207 - DNA, 656 bp, Pantoea agglomerans
tttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccaaaagcaggtagcttaccttcgggagggcgcttgccacggtgtggccgatgattggggtgaagtc

SEQ ID NO: 208 - DNA, 656 bp, Pantoea agglomerans; identical to SEQ ID NO: 121

SEQ ID NO: 209 - DNA, 652 bp, Pantoea agglomerans; identical to SEQ ID NO: 146

SEQ ID NO: 210 - DNA, 652 bp, Pseudomonas putida; identical to SEQ ID NO: 146

SEQ ID NO: 211 - DNA, 660 bp, Pseudomonas sp.
tccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggaggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccccttgtgggagggagctgtcgaaggtgggactggcgattgggac

SEQ ID NO: 212 - DNA, 654 bp, Pantoea agglomerans
gttgcacctcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttatggggagagattcccagtcctcttcggaggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggggcgacctggagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtc

SEQ ID NO: 213 - DNA, 660 bp, Pseudomonas synxantha
tcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtc

SEQ ID NO: 214 - DNA, 626 bp, Pseudomonas fluorescens
cttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacc

SEQ ID NO: 215 - DNA, 657 bp, Pseudomonas putida
ctcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaaagtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacggagtgtttcatgactggggtgaagtc

SEQ ID NO: 216 - DNA, 657 bp, Pseudomonas fluorescens; identical to SEQ ID NO: 181

SEQ ID NO: 217 - DNA, 626 bp, Pantoea vagans
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttac

SEQ ID NO: 218 - DNA, 656 bp, Stenotrophomonas maltophilia
cttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 219 - DNA, 656 bp, Pantoea agglomerans
ttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcatcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtc

SEQ ID NO: 220 - DNA, 655 bp, Burkholderia phytofirmans
tttggcacgcagaatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccaggggctacacacgtactacaatggtagggacagagggctgcaagcccggcgacggtaagccaatcccataaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaaagcaggtagcttaaccttcgggagggcgcttgccacggtgtgccgatgactggggtga

SEQ ID NO: 221 - DNA, 657 bp, Burkholderia phytofirmans
tttggcacgcagaatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcgatgaatacgttcccgggccttgtacacaccgcccgtcacaccatgggagtttgttgcaccagaagcaggtagcttaaccttcgggagggcgcttgccacgttgtgcccgatgactggggtgaagtc

SEQ ID NO: 222 - DNA, 657 bp, Streptomyces sp.
tttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggtcttgtacacaccgcccgtcacaccatgggagtttgttgcaccagaagcaggtagtttacccttcgggagggcgcttgcctcggtgtggccgatgactgggctgaagtc

SEQ ID NO: 223 - DNA, 657 bp, Methylobacterium brachiatum; identical to SEQ ID NO: 181

SEQ ID NO: 224 - DNA, 626 bp, Paenibacillus sp.; identical to SEQ ID NO: 214

SEQ ID NO: 225 - DNA, 656 bp, Pantoea agglomerans
ttggcacgcagaatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggcccttgtacacaccgcccgtcacaccatgggagtttgttgcaccagaagcaggtagcttacccttcgggagggcgcttgccacggtgtggccgatgactgggtgaagtc

SEQ ID NO: 226 - DNA, 469 bp, Luteibacter sp.
cttgaggcgtggcttccggagctaacgcgttaagtcgaccgcctggggagtacggccgcaaggttaaaactcaaatgaattgacgggggcccgcacaagcggtggaacatgtggtttaattcgatgcaacgcgaaaaaccttacctactcttgacatccacagaacttatcagaaatgctttggtgccttcgggaactctgagacaggtgctgcatggctgtcgtccgctcgtgttgtgaaatgttgggttaagtcccgcaacgagcgcaacccttatcctttgttgccagcggtcaggccgggaactctcaggagactgccagtgataaactggaggaaggtggggatgacatcaagtcatcatgggccttacaagtagggctacacacgtgctacaatggcgcatacaaagagaagcgacctcccgagagcaagcggacctcataaagtgcgtcttactccggattg

SEQ ID NO: 227 - DNA, 658 bp, Stenotrophomonas maltophilia
atttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtc

SEQ ID NO: 228 - DNA, 654 bp, Pantoea dispersa
tccgccctttagtgctgcagtaacgcattaagcactccgcctggggagtacggtcgcaagattgaaactcaaaggaattgacgggggcccgcacaagcgtggagcatgtggtttaattcgaagcaacgggaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgagtccaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtggacagatgattgggtgaagtcgt

SEQ ID NO: 229 - DNA, 651 bp, Klebsiella sp.
aggatgctgtggttggcgaagctaacgcgataaacgtaccgcctgggaagtacggccgcaaggttgaaactcaaaggaattgacgggggcccgcacaagcggtggagcatgtggtttaattcgaagcaacgcgaagaaccttaccaggtcttgacatgctaggaactcttgagagatcaggaggtgcccttcggggaacctagacacaggtgctgcatggctgtcgtcagctcgtgtcgtgagatgttgggttaagtcccgcaacgagcgcaacccttacctttagttgccagcattgagttgggcactctagagggactgcctatgaaagtaggaggaaggcggggatgacgtctagtcagcatggtccttacgacctgggctacacacgtgctacaatggatgggacaacgcgcagccaacttgcgaaagtgagcgaatcgctgaaacccatccccagttcagatcggagtctgcaactcgactccgtgaagttggaatcgctagtaatcgcaggtcagcatactgcggtgaatacgttcccgggccttgtacacaccgcccgtcacaccatgggagtaaattgcagctgaaaccgccgggagcctcacggcaggcgtctaggctgtggttcatgactggggtgaagtc

SEQ ID NO: 230 - DNA, 659 bp, Stenotrophomonas maltophilia
gcatgcacttcggtgtcgccgctaacgcattaagcattccgcctggggagtacggccgcaaggttaaaactcaaaggaattgacgggggcccgcacaagcgtggagcatgtggtttaattcgaagcaacgggaagaaccttaccaacccttgacatgtccactatgagtgagagagatcacactcttcggttcggccgggtggaacacaggtgctgcatggctgtcgtcagctcgtgtcgtgagatgttgggttaagtcccgcaacgagcgcaacccctaccgtcagttgccatcattcagttgggcactctggtggaaccgccggtgacaagccggaggaaggcggggatgacgtcaagtcctcatggcccttatgggttgggctacacacgtgctacaatggcggtgacagtgggacgcgaagtcgcgagatggagcaaatccccaaaagccgtctcagttcggatcgtactctgcaactcgagtgcgtgaagttggaatcgctagtaatcgcggatcagcacgccgcggtgaatacgttcccgggccttgtacacaccgcccgtcacaccatgggagttggctttacccgaagacggtgcgctaaccagcaatggaggcagccggccacggtaaggtcagcgactggggtgaagtc

SEQ ID NO: 231 - DNA, 614 bp, Stenotrophomonas maltophilia
tccacgggatctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaaaccgtagagatacggtcccccttgtggtcggtgtacaggtggtgcatggctgtcgtcagctcgtgtcgtgagatgttgggttaagtcccgcaacgagcgcaacccttgtcttatgttgccagcacgtaatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttg

SEQ ID NO: 232 - DNA, 658 bp, Stenotrophomonas maltophilia
tccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacaccctagaaataggggactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtc

SEQ ID NO: 233 - DNA, 654 bp, Stenotrophomonas maltophilia
ttccgccccttagtgctgcagtaacgcattaagcactccgcctggggagtacggtcgcaagactgaaactcaaaggaattgacgggggcccgcacaagcgttggagcatgtggtttaattcgaagcaacggaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtc

SEQ ID NO: 234 - DNA, 652 bp, Stenotrophomonas maltophilia
tccgccccttagtgctgcagtaacgcattaagcactccgcctggggagtacggtcgcaagattgaaactcaaaggaattgacgggggcccgcacaagcggggagcatgtggtttaattcgaagcaacgggaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtgggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcgtgaatacgttcccgggccttgtacacaccgcccgtcacaccacgagagtttgtaacacccgaagtcggtgaggtaaccttttaggagccagccgccgaagtgggacagatgattggggtgaagtc

SEQ ID NO: 235 - DNA, 304 bp, Pantoea agglomerans
cggtgacaaaccggaggaaggtggggatgacgtcaaatcatcatgccccttatgacctgggctacacacgtgctacaatggatggtacaaagagcagcaaacccgcgagggctagcaaatctcataaagccattctcagtttggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttttggaccagccggc

SEQ ID NO: 236 - DNA, 622 bp, Stenotrophomonas maltophilia
gcttgcacctcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttatggggagagattcccagtcctcttcggaggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggggcgacctggagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaaccgcaaggggcaggcg

SEQ ID NO: 237 - DNA, 623 bp, Enterobacter asburiae
tttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgcaaggaggcagcc

SEQ ID NO: 238 - DNA, 599 bp, Stenotrophomonas maltophilia
  misc_feature 4, 120, 122: N is A,T,C or G
agantgaaactcaaaggaattgacggggacccgcacaagcagtggagtatgtggtttaattcgaagcaacgcgaagaaccttaccaggtcttgacatccaactaacgaggcagagatgcntnaggtgcccttcggggaaagttgagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggaagcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagt

SEQ ID NO: 239 - DNA, 598 bp, Bacillus megaterium
  misc_feature 119, 120, 121: N is A,T,C or G
gactgaaactcaaaggaattgacggggacccgcacaagcagtggagtatgtggtttaattcgaagcaacgcgaagaaccttaccaggtcttgacatccctctgaccggtctagagatannnctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaaatcgcgaggtggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagt

SEQ ID NO: 240 - DNA, 628 bp, Deinococcus grandis
gcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggaagctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagt

SEQ ID NO: 241 - DNA, 565 bp, Azospirillum zea
  misc_feature 37: N is A,T,C or G
aaactcaaatgaattgacgggggcccgcacaagcggnggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactt

SEQ ID NO: 242 - DNA, 565 bp, Rhodococcus fascians
  misc_feature 103, 104, 105: N is A,T,C or G
aaactcaaatgaattgacgggggcccgcacaagcggtggagcatgtggtttaattcgatgcaacgcgaagaaccttacctactcttgacatccagagaacttnnnagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactt

SEQ ID NO: 243 - DNA, 314 bp, Microbacterium sp.
gcattaagtaatccacctgggaagtacgaccgcaaggttgaaactcaaaggaattggcgggggtccgcacaagcggaggagcatgtggtttaattcgatgatacgcgaggaaccttacctgggctagaatgcagtctgaccgtggagaaaagctcatttcgtagctctacgcagattgtaaggtgctgcatggttgtcgtcacctcgcgccgtgaggtgttgtgtaagtcccggacgagcgcaaccacgatcattagttgcaagaggtgaagctgggaactctaagtgaaactgccgtcgcagacacgaggagg

SEQ ID NO: 244 - DNA, 342 bp, Bacillus subtilis
gcatacgcactccgcccggggaggacggtcgcaagactgaaactcataggaattgacgggcgcccgcacaagcggtggagcatgtgttttaattcgaagcaacggtagaaccttaccaggtcttgacatcctctgtcgaccctagagatagccctttcccttcggggacagagtgatcggtggtgtgtggttggcgtcagctcgtgtcgggagatgttgggttaagtcccggacgagcgcaattcttgatattagttaccggcattcagttgggcactctaaggtgactgccggagacaacaggaggaggttggcgaggaggcataatcatcctgccctttt

SEQ ID NO: 245 - DNA, 636 bp, Bacillus subtilis
  misc_feature 44, 46, 409, 473, 616: N is A,T,C or G
agctacgcattaagcactccgcctggggagtacggtcgcaagantnaaactcaaaggaattgacgggggcccgcacaagcggggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaagntttagccaatcccacaaatctgttctcagttcggatcgcagtctgcaactcgactgcgtgaagntggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggncagatgattggggtgaagtc

SEQ ID NO: 246 - DNA, 636 bp, Bacillus asahai
agcaacgcattaagcactccgcctggggagtacggccgcaaggtgaaactcaaaggaattgacgggggcccgcacaagcgggggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcctaaggtgggatagatgattggggtgaag

SEQ ID NO: 247 - DNA, 529 bp, Methylobacterium brachiatum
  misc_feature 36, 82, 132, 341, 366, 462: N is A,T,C or G
aactcaaaggaattgacgggggcccgcacaagcggnggagcatgtggtttaattcgaagcaacgcaaagaaccttaccaggncttgacatctcctgacaatcctagagataggacgttccccttcggggganaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggnacaaagggcagcaaaaccgcgaggncgagccaatcccataaaaccattctcagttcggattgtaggctgcaactcgcctacatgaagctggaatcgctagtaatcgcggatcagcatgccncggtgaatacgttcccgggccttgtacacaccgcccgtcacaccacgagagtttgtaacacccgaag

SEQ ID NO: 248 - DNA, 565 bp, Bradyrhizobium japonicum
  misc_feature 147, 360, 362, 399: N is A,T,C or G
caaatgaattgacgggggcccgcacaagcggggagcatgtggtttaattcgatgcaacgcaaagaaccttacctggccttgacatccagagaacttagcagagatgctttggtgccttcgggaactctgagacaggtgctgcatggntgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagancnaagcggacctcataaagtgcgtcgtagtccggattgnagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtga

SEQ ID NO: 249 - DNA, 637 bp, Paenibacillus sp.
agctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtc

SEQ ID NO: 250 - DNA, 584 bp, Paenibacillus polymyxa
gtggcttccggagctaactcgttaagtcgactcgcctggggagtacggccgcaaggttaaaactcaaatgaattgacggggggccgctcaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgtagggttaagtcccgcaacgagcgcaacccttatcctttgtttccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggtgcaaaag

SEQ ID NO: 251 - DNA, 637 bp, Brevibacillus agri
  misc_feature 44, 84, 413: N is A,T,C or G
agctaacgcgttaagtcgaccgcctggggagtacggccgcaagnttaaaactcaaatgaattgacgggggcccgcacaagcggnggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagancaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 252 - DNA, 633 bp, Pantoea agglomerans
acattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaagtcgcgaggtggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtggggtaacccgcaaggaagccagccgccgaaggtggggtagatgattggggtgaagt

SEQ ID NO: 253 - DNA, 565 bp, Enterobacter sp.
ctcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgg

SEQ ID NO: 254 - DNA, 637 bp, Sediminibacterium sp.
  misc_feature 278: N is A,T,C or G
agctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttnggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 255 - DNA, 638 bp, Bacillus pumilus
  misc_feature 18, 85, 201, 398, 399: N is A,T,C or G
agctaacgcgttaagtcngaccgcctggggagtacggccgcaaggttaaaactcaaatgaattgacgggggcccgcacaagcggnggagcatgtggtttaattcgatgcaacgcgaagaaccttacctactcttgacatccagagaacttagcagagatgctttggtgccttcgggaactctgagacaggtgctgcatggntgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagnngcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 256 - DNA, 271 bp, Bacillus pumilus
agctaacgcattaagttccccgcctggggagtacggccgcaaggtaaaactcaaaggaattgacggggacccgcacaagcgggggagttgggaattaattcgatgcaacggaagaactttaccaggctttgccatatacgaaaacgggccagaaatggccacctctttggacactcgtaaacgggtggggcttgtttgtcgccagcccgtgtcgggaaatgttgggttaagtcccgaaacgggcgcaaccctcgttctttgttgccagccc

SEQ ID NO: 257 - DNA, 347 bp, Bacillus circulans
gcttaagtaatccacctggggagtacgaccgcaaggttgaactcaaaggaattggcgggggccgcacaagcgaggagcatgtggtttaattcgatgatacgcgaggaaccttacctgggctagaatgctgtctgaccgtgggaaaagcacatttcgtatcaatacgcagattgtaagctgctgacatggcgtcgtctcctcgtgccgtgagttgttgtgttacgtccagcgacgagcgcaacccctatcattagttgccaagagatgaagctggtaactctagtgaaactgctgccgcaggagaggaggaaggagggatgacggaaatcatcatcttcattatgggg

SEQ ID NO: 258 - DNA, 607 bp, Bacillus nealsonii
gcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtg

SEQ ID NO: 259 - DNA, 622 bp, Pantoea agglomerans; identical to SEQ ID NO: 236

SEQ ID NO: 260 - DNA, 565 bp, Bacillus pumilus
actcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttg

SEQ ID NO: 261 - DNA, 637 bp, Enterobacter sp.; identical to SEQ ID NO: 249

SEQ ID NO: 262 - DNA, 528 bp, Pantoea agglomerans
agctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccggg

SEQ ID NO: 263 - DNA, 636 bp, Paenibacillus polymyxa
  misc_feature 44, 84: N is A,T,C or G
agctaacgcgttaagtcgaccgcctggggagtacggccgcaagnttaaaactcaaatgaattgacgggggcccgcacaagcggnggagcatgtggtttaattcgatgcaacgcgagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 264 - DNA, 629 bp, Enterococcus gallinarum
gcgttaagtcgaccgcctggggagcacggacgcaaggttaaaactcaaatgaattgacgggggcccgcacaagcggtggagcatgtggtttaattcgatgcaacgcgaagaaccttacctactcttgaaatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagt

SEQ ID NO: 265 - DNA, 377 bp, Enterobacter asburiae
  misc_feature 128, 142, 182, 309: N is A,T,C or G
agctaacgcgataagtcgaccgcctggggagtacggccgcaagattaaaactcaaatgaattgacgggggcccgcacaagcggtggagcatgtggtttaattcgatgcaacgcgaagaaccttacctnctcttgacatccanagaactttccagagatggattggtgccttcgggaactctnatacaggtgctgcatggctgtcgtcagctcgtgttgtgaaatgttgggttaagtcccgcaacgagcgcaacccttatcctttgttgccagcgagtagagccggaacttttaggagactgccaggganaaactggaggaaggtggggatgacgtcaagtcattctggcccttaacagtagggctacccacgtgcta

SEQ ID NO: 266 - DNA, 354 bp, Pantoea agglomerans
gcgataagtcgaccgcctggggagtacggccgcaagattaaaactcaaatgaattgacgggggcccgcacaagcggtggagcatgtggtttaattcgatgcaacgcgaagaaccttacctgctcttgacatccaaagaactttccagagatggattggtgccttcgggaactctgatacaggtgctgcatggctgtcgtcagctcgtgttgtgaaatgttgggttaagtcccgcaacgagcgcaacccttttcctttgttgccagcgagtaatgcgggaaactttaagagaccggccgggaacaaccggaggaaggtggggatgacgtccaggcatccttggcccctaacagca

SEQ ID NO: 267 - DNA, 622 bp, Microbacterium schleiferi; identical to SEQ ID NO: 236

SEQ ID NO: 268 - DNA, 395 bp, Sediminibacterium sp.
ctcttacacaggtgctgcatggctgtcgtcagctcgagttgtgaaatttagggttaagtcccgcaacgagcgcaacccttatcctttttttccagcggttcggtcgggatctcaaacgagactgccactgataaactggaggaaggtggggatgacggcaagtcatcatgccccttccgagtagggctacccccgtgctacaatggccagtacaaagagaagcgacctcgcgagagcaagcggacctcataaagtgcgtcgtagtcccgagtggagtctgcaactcgactccatgaagtcggaatcgctagtaatcgtagatcagaatgctccggtgaatacgttcccgggccttgtacacacccaccgtcccaccatgggagtgggtgcaaaag

SEQ ID NO: 269 - DNA, 330 bp, Enterococcus gallinarum
  misc_feature 89, 161, 201, 261, 295: N is A,T,C or G
agctgaaagcattgagcactccgtctggagagtaggggcgcgagattaactctcagagaatttgacggacccccgcaaaagcgggatantgtgttttttaactctaagcaacgaaaaaccttatacacgttcgagacatcctctgattgccatagagatantactttcccttcgagaacagagacacaggtgctgcatggntgtcgtcagctcgtgtcgtgagatgttgggttaagtcccgcaacgagcgcaacccttgtncttagttgctagattttggttgggccctttatgnggactgcggggaaaaaacggaggaaggtggggata

SEQ ID NO: 270 - DNA, 723 bp, Methylobacterium brachiatum
atccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcga

SEQ ID NO: 271 - DNA, 792 bp, Enterobacter cloacae
ggcgtaaagcgtgcgtaggtggtcgtttaagtctgttgtgaaagccctgggctcaacctgggaactgcagtggaaactggacgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcag

SEQ ID NO: 272 - DNA, 663 bp, Bacillus pumilus
aatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgca

SEQ ID NO: 273 - DNA, 741 bp, Enterobacter cloacae
gaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgcta

SEQ ID NO: 274 - DNA, 755 bp, Enterobacter cloacae
gtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcaagcacgcgagtgtgagctaatctccaaaagccatctcagttcggattgcactctgcaactcgagtgcatgaagttggaatcgctagtaatc

SEQ ID NO: 275 - DNA, 720 bp, Enterobacter cloacae
ttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgc

SEQ ID NO: 276 - DNA, 618 bp, Enterobacter hormaechei
attgcgaaggcaggttactactaatggattgacgctgatggacgaaagcgtgggtagcgaacaggattagataccctggtagtccacgccgtaaacgatggatactagctgttggaagcaatttcagtggctaagcgaaagtgataagtatcccacctggggagtacgaacgcaagtttgaaactcaaaggaattgacgggggcccgcacaagcggtggagcatgtggtttaattcgatgatacgcgaggaaccttaccaaggcttaaatgcagactgaccgatttggaaacagatctttcgcaagacagtttacaaggtgctgcatggttgtcgtcagctcgtgccgtgaggtgtcaggttaagtcctataacgagcgcaacccctgttgttagttgccagcgagtagtgtcgggaactctaacaagactgccagtgcaaactgtgaggaaggtggggatgacgtcaaatcatcacggcccttacgccttgggctacacacgtgctacaatggccggtacagagagcagccactgggcgaccaggagcgaatctataaagccggtcacagttcggatcggagtctgcaactcgactccgtgaagctggaatcgctag

SEQ ID NO: 277 - DNA, 585 bp, Pantoea sp.
gaggcgcgaaagcgtggggagcaaccaggattagataccctggtagtccacgccgtaaacgatgaatgctaggtgttaggggtttcgatacccttggtgccgaagttaacacattaagcattccgcctggggagtacgctcgcaagagtgaaattcaaaggaattgacggggacccgcccaagcagtggagtatgtggtttaattggaagcaacgcgaagacccttaccagctcttgacatttgagtgaaagcaccagagatggtgccctttttcggaacactcaagccaggtggtgcatggttgtcgtcagctcgtgtcgtgagatgttgggttaagtcccgcaacgagcccaccccttgattttagttgccagcacttcgggtgggcactctaaggtgactgccggtgacaaaccggaggaaggtggggatgacgtcaaatcatcatgccccttatgagctgggctacacacgtactacaatggccggtacaacgggaagcgaaaccgcgaggtggagccaatcctatcaaagccggtctcagttcggattgcaggctgcaactcgcctgcatgaagtcggaa

SEQ ID NO: 278 - DNA, 677 bp, Methylobacterium brachiatum
ggggtagcggtggaatgcgcagatatcaggaggaacaccgatggcgaaggcaggtctctgggcacttactgacgctgaggagcgaaagcgtggggagcgaacaggattagataccctggtagtccacgccgtaaacgttgggcgctagatgtggggacctttccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacacgagaacgggccagaaatggtcaactctttggacactcgtgaacaggtggtgcatggttgtcgtcagctcgtgtcgtgagatgttgggttaagtcccgcaacgagcgcaaccctcgtcgcatgttgccagcacgttatggtggggactcatgtgagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcag

SEQ ID NO: 279 - DNA, 721 bp, Enterobacter asburiae
cagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacg

SEQ ID NO: 280 - DNA, 800 bp, Bacillus pumilus
aattattgggcgtaaagagctcgtagggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcag

SEQ ID NO: 281 - DNA, 719 bp, Pseudomonas protegens
ggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtgggggccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtccagagatggtcgccccgcaaggtcggtatacaggtggtgcatggttgtcgtcagctcgtgtcgtgagatgttgggttaagtcccgcaacgagcgcaaccctcgttctatgttgccagcacgtttatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcag

SEQ ID NO: 282 - DNA, 798 bp, Stenotrophomonas maltophilia
tttattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcgataccgtgaggtggagcgaatcccaaaaagccggtcccagttcggattgaggtctgcaactcgacctcatgaagtcggagtcgctagtaatcgca

SEQ ID NO: 283 - DNA, 575 bp, Stenotrophomonas maltophilia
ccggtggcgaaggcgggtctctgggcagtaactgacgctgaggagcgaaagcgtgggtagcgaacaggattagataccctggtagtccacgccgtaaacggtgggtactaggtgtgggtttccttccttgggatccgtgccgtagctaacgcattaagtaccccgcctggggagtacggtcgcaagactaaaactcaaaggaattgacgggggcccgcacaagcggcggagcatgtggattaattcgatgcaacgcgaagaaccttacctgggtttgacatgcacaggacgtacctagagataggtattcccttgtggcctgtgtgcaggtggtgcatggctgtcgtcagctcgtgtcgtgagatgttgggttaagtcccgcaacgagcgcaacccttgtcctatgttgccagcgggtaatgccggggactcgtaggagactgccggggtcaactcggaggaaggtggggatgacgtcaagtcatcatgccccttatgtccagggcttcacacatgctacaatggccagtacagagggctgcgaaccgcaaggtggagcgaatcccttaaagctg

SEQ ID NO: 284 - DNA, 624 bp, Ochrobactrum tritici
ttgggcagtaactgacgctgaggagcgaaagcgtgggtagcgaacaggattagataccctggtagtccacgccgtaaacggtgggtactaggtgtgggtttccttccttgggatccgtgccgtagctaacgcattaagtaccccgcctggggagtacggtcgcaagactaaaactcaaaggaattgacgggggcccgcacaagcggcggagcatgtggattaattcgatgcaacgcgaagaaccttacctgggtttgacatgcacaggacgtacctagagataggtattcccttgtggcctgtgtgcaggtggtgcatggctgtcgtcagctcgtgtcgtgagatgttgggttaagtcccgcaacgagcgcaacccttgtcctatgttgccagcgggtaatgccggggactcgtaggagactgccggggtcaactcggaggaaggtggggatgacgtcaagtcatcatgccccttatgtccagggcttcacacatgctacaatggccagtacagagggctgcgaagccgcaaggtggagcgaatcccttaaagctggtctcagttcggattggggtctgcaactcgaccccatgaagtcggagtcgctagtaatcgcagatcag

SEQ ID NO: 285 - DNA, 630 bp, Ochrobactrum grignonense
ggcagatctctgggccgctactgacgctgaggagcgaaagggtggggagcaaacaggcttagataccctggtagtccaccccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggacgacgtcaaatcatcatgccccttatgtcttgggcttcacgcatgctacaatggccagtacaaagggctgcaataccgtaaggtggagcgaatcccaaaaagctggtcccagttcggattgaggtctgcaactcgacctcatgaagtcggagtcgctagtaatcgcaga

SEQ ID NO: 286 - DNA, 381 bp, Sphingomonas yanoikuyae
acgcgaagaaccttacctggtcttgacatccacagaagtttccagagatgggaatgtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagta

SEQ ID NO: 287 - DNA, 380 bp, Flavobacterium johnsoniae
aacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaaaccgcgaggtggagctaatcccataaaaccgatcgtagtccggatcgcagtctgcaactcgactgcgtgaagtcggaatcgcta

SEQ ID NO: 288 - DNA, 373 bp, Paenibacillus humicus
aagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacaaagggctgcaagctagcgatagtgagcgaatcccagaaagcgcgtcgtagtccggattggagtctgcaactcgactccatgaagtcggaatcgct

SEQ ID NO: 289 - DNA, 350 bp, Agromyces mediolanus
aacgcgaagaaccttacctacccttgacatggtcggaatcctgaagagatttgggagtgctcgaaagagaaccggcgcacaggtgctgcatggctgtcgtcagctcgtgtcgtgagatgttgggttaagtcccgcaacgagcgcaacccttgtcattagttgttacgaaagggcactctaatgagactgccggtgacaaaccggaggaaggtggggatgacgtcaagtctctcatggcccttatgggtagggcttcacacgtcatacaatggtacatacagagggccgccaacccgcgagggggagctaatcccagaaagtgtatcgtagtccggattgtagtctgcaat

SEQ ID NO: 290 - DNA, 382 bp, Curtobacterium citreum
aacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagt

SEQ ID NO: 291 - DNA, 382 bp, Curtobacterium herbarum
aacgcgaagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgcta

SEQ ID NO: 292 - DNA, 376 bp, Frigoribacterium faeni
aacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcg

SEQ ID NO: 293 - DNA, 382 bp, Microbacterium oleivorans
aacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagta

SEQ ID NO: 294 - DNA, 383 bp, Mycobacterium abscessus
aacgcgaagaaccttacctggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagta

SEQ ID NO: 295 - DNA, 380 bp, Mycobacterium abscessus
aacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctag

SEQ ID NO: 296 - DNA, 375 bp, Plantibacter  flavus
aagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagta

SEQ ID NO: 297 - DNA, 378 bp, Enterobacter cloacae subsp. cloacae
aagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaa

SEQ ID NO: 298 - DNA, 373 bp, Pseudomonas oryzihabitans
aacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcacgtaatggtgggaactctaaggagactgccggtgacaaaccggaggaaggtggggatgacgtcaagtcatcatggcccttacggccagggctacacacgtactacaatggtcggtacagagggttgcaataccgcgaggtggagccaatcccagaaagccgatcccagtccggatcgaagtctgcaactcgacttcgtgaagtcgga

SEQ ID NO: 299 - DNA, 378 bp, Aeromonas hydrophila subsp. dhakensis
aacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgc

SEQ ID NO: 300 - DNA, 380 bp, Herbaspirillum rubrisubalvicans
aacgcgaagaaccttaccaggtcttgacatcctctgacaaccctagagatagggccttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagagcccgcaaacccgcgagggtaagctaatctcataaagccattctcagttcggattgcaggctgcaactcgcctgcatgaagccggaatcgct

SEQ ID NO: 301 - DNA, 379 bp, Acinetobacter beijerinckii
aacgcgaagaaccttaccaggtcttgacatccatggaactcctgagagatcaggaggtgcccttcggggagccatgagacaggtgctgcatggctgtcgtcagctcgtgtcgtgagatgttgggttaagtcccgcaacgagcgcaacccttgcctttagttgtcagcattcagttggacactctagagggactgcctatgaaagtaggaggaaggcggggatgacgtctagtcagcatggtccttacgacctgggctacacacgtgctacaatggatgggacaacgcgctgccagcctgcgaaggtgcgcgaatcgctgaaacccatccccagttcagatcggagtctgcaactcgactccgtgaagttggaatcgcta

SEQ ID NO: 302 - DNA, 374 bp, Rhizobium radiobacter
aacgcgaagaaccttacctacccttgacatgtctggaattcctaagagattgggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggattgcaggctgcaactcgcctgcatgaagtcggaatcgct

SEQ ID NO: 303 - DNA, 730 bp, Enterobacter arachidis
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttggcagagatgctttggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtagatagcttaaccttcgggagggcgtttaccactttgtgattcatgactggggtgaagtcgtaacaaggtaacc

SEQ ID NO: 304 - DNA, 729 bp, Escherichia coli
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggcgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtagtagcttaaccttcgggagggcgcttaccactttgtgattcatgactggggtgaagtcgtaacaaggtaacc

SEQ ID NO: 305 - DNA, 730 bp, Stenotrophomonas maltophilia
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatggattggtgccttcgggaactgtgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 306 - DNA, 730 bp, Pantoea agglomerans
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 307 - DNA, 730 bp, Neisseria meningitidis
aacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttacaaaagaagtaggtagcttaaccttcgggagggcgcttaccactttgtgattcatgactggggtgaagtcgtaacaaggtaacc

SEQ ID NO: 308 - DNA, 730 bp, Pseudomonas protegens
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 309 - DNA, 730 bp, Dyella ginsengisoli
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcagctcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 310 - DNA, 732 bp, Pseudomonas putida
aacaggattagataccctggtagtccacgccgtaaacgatgataactagctgtcagggcacatggtgttttggtggcgcagctaacgcgttaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagtcgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacggtgggtttagcgactggggtgaagtcgtaacaaggtaacc

SEQ ID NO: 311 - DNA, 730 bp, Bacillus psychrosaccharolyticus
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 312 - DNA, 730 bp, Deinococcus ficus
aacaggattagataccctggtagtccacgccgtaaacgatgtcgacttggaggttgtgcccttgaggcgtggcttccggggctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccggagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 313 - DNA, 732 bp, Achromobacter spanius
aacaggattagataccctggtagtccacgccgtaaacgatgagtgctaagtgtcgggggtgaccaaccctcggtgctgtcgctaacgcaataagcgctccgcctggggagtacggccgcaaggctgaaactcaaaggaattgacggggacccgcacaagcggtggagcatgtggtttaattcgaagcaacgcgaagaaccttaccaaggcttgacatccccctgaccgatttagagatagatctttcccttcggggacaggggtgacaggtggtgcatggttgtcgtcagctcgtgtcgtgagatgttgggttaagtcccgcaacgagcgcaacccttatctttagttgccagcattcagttgggcactctagagagactgccggtgacaaaccggaggaaggtggggatgacgtcaaatcatcatgccccttatgtcttgggctacacacgtgctacaatggttggtacaaagggctgcaagccagcgatggtaagccaatcccataaagccaatctcagttcggattgtaggctgcaactcgcctacatgaagtcggaatcgctagtaatcgcagatcagcatgctgcggtgaatacgttcccgggtcttgtacacaccgcccgtcacaccacgagagtttacaacacccgaagtcggtgaggtaaccgcaaaggagccagccgcctaagtgggggtagatgattggggtgaagtcgtaacaaggtaacc

SEQ ID NO: 314 - DNA, 732 bp, Tatumella morbirosei
aacaggattagataccctggtagtccacgccgtaagcgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagataggccttcccttcggggcagaggagacaggtggtgcatggttgtcgtcagctcgtgtcgtgagatgttgggttaagtcccgcaacgagcgcaacccctatttttagttgccagcactttgggtgggcactctaaagagactgccggtgacaaaccggaggaaggtggggatgacgtcaaatcatcatgccccttatgacctgggctacacacgtactacaatggccagtacaacgggaagcgaagtcgcgagacggagccaatcctatcaaagctggtctcagttcggattgcaggctgcaactcgcctgcatgaagtcggaattgctagtaatcgcggatcagcatgccgcggtgaatacgttcccgggccttgtacacaccgcccgtcacaccatgggagtgggttgcaaaagaagtagatagcttaaccttcgggagggcgtttaccactttgtgattcatgactggggtgaagtcgtaacaaggtaacc

SEQ ID NO: 315 - DNA, 733 bp, Leclercia adecarboxylata
aacaggattagataccctggtagtccacgccgtaaacgatgaatgccagccgttggggtgcatgcacctcagtggcgcagctaacgctttaagcattccgcctggggagtacggccgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagggcgacctcgagctaatcccaaaaagccgtctcagttcagattgtactctgcaactcgagtacatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtgggctcattcgactggggtgaagtcgtaacaaggtaacc

SEQ ID NO: 316 - DNA, 731 bp, Enterobacter dissolvens
aacaggattagataccctggtagtccacgccgtaaacgatgtctactagctgttcgtggtcttgtactgtgagtagcgcagctaacgcactaagtagaccgcctggggagtacggtcgcaagattaaaactcaaatgaattgacgggggcccgcacaagcggtggagcatgtggtttagttcgacgcaacgcgaagaaccttacctactcttgacatctacggaagactgcagagatgcggttgtgccttcgggaaccgtaagacaggtgctgcatggctgtcgtcagctcgtgttgtgaaatgttgggttaagtcccgcaacgagcgcaacccctatccttagttgccagcacgtaatggtgggaactctagggagactgccggtgataaaccggaggaaggtggggacgacgtcaagtcatcatggcccttacgagtagggctacacacgtgctacaatggtacgtacagagggaggcaagctggcgacagtgagcggatctcttaaagcgtatcgtagtccggatcgcagtctgcaactcgactgcgtgaagtcggaatcgctagtaatcgcaaatcagaatgttgcggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 317 - DNA, 730 bp, Enterobacter cancerogenus
aacaggattagataccctggtagtccatgccgtaaacgatgtctactagccgttggggcctttgaggctttagtggcgcagctaacgcgataggtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttcctcacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccaggagtagctagcctaactgcaaagagggcggttaccacggtgtggccgatgactggggtgaagtcgtaacaaggtaacc

SEQ ID NO: 318 - DNA, 731 bp, Serratia marcescens
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttcctcatttgccagcgggttaagccgggaactttaaggatactgccagtgacaaactggaggaaggcggggacgacgtcaagtcatcatggcccttacgaccagggctacacacgtgctacaatggtcggtacaaagggttgctgcctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggaatttgttgcaccagaagtaggtagtctaaccgcaaggaggacgcttaccacggtgtggccgatgactggggtgaagtcgtaacaaggtaacc

SEQ ID NO: 319 - DNA, 731 bp, Erwinia cypripedi
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggacttgtacacaccgcccgtcacaccatgggagtttgttgcaccagaagtaggtagtctaaccttaggggggacgcttaccacggcgtggcagatgactggggtgaagtcgtaacaaggtaacc

SEQ ID NO: 320 - DNA, 731 bp, Erwinia aphidicola
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactaagaactttccagagatggattggtgccttcgggaacttagatacaggtgctgcatggctgtcgtcagctcgtgtcgtgagatgttgggttaagtcccgcaacgagcgcaacccttttccttatttgccatcgggtaatgccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcgtaccacggtgtggccgatgactggggtgaagtcgtaacaaggtaacc

SEQ ID NO: 321 - DNA, 725 bp, Sphingomonas yanoikuyae
aacaggattagataccctggtagtccacgccctaaacgatgtcaactggttgttgggagggtttcttctcagtaacgtagctaacgcgtaaagttgaccgcctggggagtacggccgcaaggttgaaactcaaaggaattgacggggacccgcacaagcggtggatgatgtggtttaattcgatgcaacgcgaaaaaccttacctacccttgacatgccaggaatcttgcagagatgtgagagtgctcgaaagagaacctggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtaacc

SEQ ID NO: 322 - DNA, 725 bp, Pantoea anthophila
aacaggattagataccctggtagtccacgccctaaacgatgtcaactggttgttgggagggtttcttctcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgccaggaatcttgcagagatgtgagagtgctcgaaagagaacctggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgcagtctgcaactcgactgcgtgaagtcggaatcgccagtaatcgcggatcagcttgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaacc

SEQ ID NO: 323 - DNA, 725 bp, Pantoea dispersa
aacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacgcaccgcccgtcacaccatgggagtgggttttaccagaagtggctagtctaaccgcaaggaggacggtcaccacggtaggattcatgactggggtgaagtcgtaacaaggtaacc

SEQ ID NO: 324 - DNA, 734 bp, Oxalophagus oxalicus
aacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaaccctgcgaggggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtaacc

SEQ ID NO: 325 - DNA, 729 bp, Paenibacillus nanensis
aacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaagccacgagaggtcgaggtgtgctcgaaagagaaccgtaacacaggtgctgcatggctgtcgtcagctcgtgtcgtgagatgttgggttaagtcccgcaacgagcgcaacccttgtcattagttgctacatttagttgagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgcagtctgcaactcgactgcgtgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtaacc

SEQ ID NO: 326 - DNA, 726 bp, Bosea vestrisii
aacaggattagataccctgcgtagtccacgccctaaacgatgtcaactagttgtcgggtcttaattgacttggtaacgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggcaggaatcctggagagatccgggagtgctcgaaagagaacctgcacacaggtgctgcatggctgtcgtcagctcgtgccgtgagacgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtaacc

SEQ ID NO: 327 - DNA, 731 bp, Rheinheimera soli
aacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtaacc

SEQ ID NO: 328 - DNA, 730 bp, Acinetobacter baumannii
aacaggattagataccctggtagtccacgccgtaaacgatggaagctagccgttggtaagcatgcttatcagtggcgcagctaacgcattaagcttcccgcctggggagtacggtcgcaagattaaaactcaaaggaattgacgggggcccgcacaagcggtggagcatgtggttcaattcgacgcaacgcgaagaaccttaccagcccttgacatgtccaggaccggtcgcagagacgcgaccttctcttcggagcctggaacacaggtgctgcatggctgtcgtcagctcgtgtcgtgagatgttgggttaagtcccgcaacgagcgcaaccctcgtccttagttgccatcattaagttgggcactctaaggagactgccggtgataagccgcgaggaaggtggggatgacgtcaagtcctcatggcccttacgggctgggctacacacgtgctacaatggcagtgacaatgggcagcgaacccgcaagggggagctaatctctaaaaaccgtctcagttcggattgcactctgcaactcgagtgcatgaagttggaatcgctagtaatcgtggatcagcatgccacggtgaatacgttcccgggccttgtacacaccgcccgtcacaccatgggagttggttttaccttaagacggtgcgctaaccgcaaggaggcagccggccacggtaaggtcagcgactggggtgaagtcgtaacaaggtaacc

SEQ ID NO: 329 - DNA, 733 bp, Acinetobacter johnsonii
aacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtaacc

SEQ ID NO: 330 - DNA, 730 bp, Acinetobacter beijerinckii
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccctatcctttgttgccagcggtccggccgggaactcaaaggagactgccagtgataaactggaggaaggtggggatgacgtcaagtcatcatggcccttacgaccagggctacacacgtgctacaatggcgcatacagagagaagcgacctcgcgagagcaagcggacctcataaagtgtgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 331 - DNA, 730 bp, Acinetobacter schindleri
aacaggattagataccctggtagtccacgccgtaaacgatggacacttggtgttggaggtattgaccccttcagtgccgaagctaacgcgttaagtgtcccgcctggggagtacggccgcaaggttaaaactcacagaaattgacgggggcccgcacaagcggtggagcatgtggtttaattcgatgcaacgcgcagaaccttacctagatttgacatgtaatggaagactggcagaaatgtcgtcgcccgcaagggccgttacacaggtgctgcatggctgtcgtcagctcgtgtcgtgagatgttgggttaagtcccgcaacgagcgcaacccctatgtttagttgccagcattcagttgggcactctagacagactgccggtgttaaaccggaggaaggtggggatgacgtcaagtcctcatggcctttatatctagggctacacacgtgctacaatggtcggtacagagggaagcaagagtgcgaactggagctaatcccaaaaaaccgatctaagttcggatagaagtctgcaactcgacttcttgaagctggaatcgctagtaatcgtggatcagaacgccacggtgaatacgttcccgggccttgtacacaccgcccgtcacaccatgaaagttgtgcctaccagaagtcactgcgttaaccgcaaggagacaggtgcccaaggtaggaacgatgattggggtgaagtcgtaacaaggtaacc

SEQ ID NO: 332 - DNA, 730 bp, Roseateles depolymerans
aacaggattagataccctggtagtccacgccgtaaacgatgtcgacttggaggttgtgcccttgaggcgtggcttccggagctaacgcgttaagtcgaccgcctggggagtacggccgcaaggttcaaactcaaatgaattgacgggggcccgcacaagcggtggagcatgtggcttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgcacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 333 - DNA, 729 bp, Roseateles terrae
aacaggattagataccctggtagtccacgccgtaaacaatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatcctgcagagatgcgggagtgccttcgggaattcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatcccaaaaagcctatcgtagtccggattggagtctgcaactcgactccatgaagtcggaatcgctagtaatcgcagatcagaatgctgcggtgaatacgttcccgggccttgtacacaccgcccgtcacaccatgggagtctattgcaccagaagtaggtagcctaacgcaagagggcgcttaccacggtgtggtcgatgactggggtgaagtcgtaacaaggtaacc

SEQ ID NO: 334 - DNA, 730 bp, Burkholderia diffusa
aacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaattcgccagagatggcttagtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacataccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggtttcgtgactggggtgaagtcgtaacaaggtaacc

SEQ ID NO: 335 - DNA, 734 bp, Sphingopyxis panaciterrae
aacaggattagataccctggtagtccacgccgtaaacgatgagtgctagacgtcgggaagcttgcttttcggtgtcgcagctaacgcattaagcactccgcctggggagtacggccgcaaggttaaaactcaaaggaattgacgggggcccgcacaagcggtggagcatgtggtttaattcgatgcaacgcgaagaaccttaccagctcttgacatattgggttatggattcgagagatcgattccttcagttcggctgggcccagtacaggtgctgcatggctgtcgtcagctcgtgtcgtgagatgttgggttaagtcccgcaacgagcgcaaccctcatcttcagttgccatcaggtcaagctgggcactctgaagaaactgccggtgacaagccggaggaaggtggggatgacgtcaagtcctcatggcccttacgggctgggctacacacgtgctacaatgacggtgacagtgggatgcgatggcgcgagccggagcgaatctccaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggttttaccttaagacggtgcgctaaccgcaaggaggcagccggccacggtaaggtcagcgactggggtgaagtcgtaacaaggtaacc

SEQ ID NO: 336 - DNA, 732 bp, Massilia aerolata
aacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacagtgggtttagcgactggggtgaagtcgtaacaaggtaacc

SEQ ID NO: 337 - DNA, 729 bp, Massilia albidiflava
aacaggattagataccctggtagtccgcgccgtaaactatgagagctagccgttggagggtttacccttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggcaagacggttcccagagatgggttccttcacttcggtgacttgcacacaggtgctgcatggctgtcgtcagctcgtgtcgtgagatgttgggttaagtcccgcaacgagcgcaaccctcgtccttagttgccatcatttagttgggcactctaaggagactgccggtgataagccggaggaaggtggggatgacgtcaagtcatcatggcccttatgggctgggctacacacgtgctacaatggcggtgacagagggcagctacacggcgacgtgatgctaatcccaaaaaaccgtctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtaacc

SEQ ID NO: 338 - DNA, 730 bp, Pseudomonas poae
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcttttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatatgtccccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 339 - DNA, 732 bp, Ancylobacter rudongensis
aacaggattagataccctggtagtccacgccgtaaacgatgaagactagctgtcagggcgcttagcgctttggtggcgcagctaacgcattaagtcttccgcctggggagtacggccgcaaggttaaaactcaaaggaattgacgggggcctgcacaagcggtggagcatgtggtttaattcgaagcaacgcgcagaaccttaccagcgtttgacatcccgatcgcggagagtggagacacactccttcagttaggctggatcggtgacaggtgctgcatggctgtcgtcagctcgtgtcgtgagatgttgggttaagtcccgcaacgagcgcaaccctcgcctttagttgccatcatttagttgggcactctaaaggaactgccggtgataagccggaggaaggtggggatgacgtcaagtcctcatggcccttacgcgctgggctacacacgtgctacaatggcggtgacagtgggctgcaatcccgcaagggggagcaaatctccaaaagccgtctcagttcggattgtcctctgcaactcgagggcatgaaggcggaatcgctagtaatcgcggatcagcatgccgcggtgaatacgttcccaggccttgtacacaccgcccgtcacaccatgggagttggtttcacctgaaggcagtgcgctaaccgcaaggaggcagctgaccacggtgggatcagcgactggggtgaagtcgtaacaaggtaacc

SEQ ID NO: 340 - DNA, 735 bp, Stenotrophomonas pavanii
aacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgatcggtctagggatagatctttccttcgggacaggggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaaagagcgatctggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtaacc

SEQ ID NO: 341 - DNA, 731 bp, Shigella flexneri
aacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttgccaggtcttgacatccctctgaccggtacagagatgtatctttccttcgggacagaggagacaggtggtgcatggttgtcgtcagctcgtgtcgtgagatgttgggttaagtcccgcaacgagcgcaacccttgatcttagttgccagcatttcggatgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacgcccgaagtcggtggggtaaccgcaaggagccagccgccgaaggtgggatagatgattggggtgaagtcgtaacaaggtaacc

SEQ ID NO: 342 - DNA, 731 bp, Bdellovibrio bacteriovorus
aacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgacgcaacgcgaagaaccttaccaggtcttgacatcctctgacaactccagagatggagctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacagagggaagcgaaaccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaacctttttggagccagccgccgaaggtgggactgatgattggggtgaagtcgtaacaaggtaacc

SEQ ID NO: 343 - DNA, 730 bp, Enterobacter cancerogenus
aacaggattagataccctggtagtccatgccgtaaacggtgggcgctaggtgtgagggtcttttcacgactttcgtgccgtagcaaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactggatcgctgcagagatgtagtttccctttgtggctggtgtacaagtggtgcatggttgtcgtcagctcgtgtcgtgagacgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcccaaacttgttagggagccgtcgaaggtgggatcggcgattgggacgaagtcgtaacaaggtaacc

SEQ ID NO: 344 - DNA, 735 bp, Enhydrobacter aerosaccus
aacaggattagataccctggtagtccatgccgtaaacggtgggtactaggtgtggggctccttccacggactccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatacaccagaaagcggcagagatgtcgccccccttgtggttggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtaacc

SEQ ID NO: 345 - DNA, 733 bp, Variovorax boronicumulans
aacaggattagataccctggtagtccacgccgtaaacggtgggtgctaggtgtggggggcttccacgccctctgtgccgcagctaacgcattaagcaccccgcctggggagtacggccgcaaggctaaaactcaaaggaattgacgggggcccgcacaagcggcggagcatgtggattaattcgatgcaacgcgaagaaccttacctgggcttgacatggactagaaagctctagagatagagcctcccttgtggctggttcacaggtggtgcatggctgtcgtcagctcgtgtcgtgagatgttgggttaagtcccgcaacgagcgcaaccctcgttccatgttgccagcacgtaatggtggggactcatgggagactgccggggtcaactcggaggaaggtggggatgacgtcaagtcatcatgccccttatgtccagggcttcacacatgctacaatggccggtacaaagggctgctaagccgtgaggtggagcgaatcccataaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagcccgtggctcaacccgcaagggggagagcggtcgaaggtgggactggcgattgggacgaagtcgtaacaaggtaacc

SEQ ID NO: 346 - DNA, 714 bp, Oceanibaculum pacificum
aacaggattagataccctggtagtccacgccgtaaacgatggatactagctgttgggagcaatctcagtggctaagcgaaagtgataagtatcccacctggggagtacgaacgcaagtttgaaactcaaaggaattgacgggggcccgcacaagcggtggagcatgtggtttaattcgatgatacgcgaggaaccttaccaaggcttaaatgtagattgacaggactggaaacagttttttcttcggacaatttacaaggtgctgcatggttgtcgtcagctcgtgccgtgaggtgtcaggttaagtcctataacgagcgcaacccctgttgttagttgccagcgagtcaagtcgggaactctaacaagactgccagtgcaaactgtgaggaaggtggggatgacgtcaaatcatcacggcccttacgccttgggctacacacgtgctacaatggccggtacagagagcagccattgggtgaccaggagcgaatctacaaaaccggtcacagttcggatcggagtctgcaactcgactccgtgaagctggaatcgctagtaatcggatatcagccatgatccggtgaatacgttcccgggccttgtacacaccgcccgccaagccatggaagctgggggtgcctgaagtcggtgaccgcaaggagctgcctagggtaaaactggtaactagggctaagtcgtaacaaggtaacc

SEQ ID NO: 347 - DNA, 714 bp, Sphingomonas yanoikuyae
aacaggattagataccctggtagtccacgccgtaaacgatggatactagctgttcggagcaatctgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtagtctgacaggaccggaaacggttttttcttcggacagattacaaggtgctgcatggttgtcgtcagctcgtgccgtgaggtgccaggttaagtcctataacgagcgcaacccctgtcgttagttgccagcgagtcatgtcgggaactctaacgagactgccagtgcaaactgagaggaaggtggggatgacgtcaaatcatcacggcccttacgccctgggctacacacgtgctacaatgggcggtacagagagcagccactccgcgaggaggagcgaatctacaaaaccgttcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaaccggtaactggggctaagtcgtaacaaggtaacc

SEQ ID NO: 348 - DNA, 716 bp, Devosia riboflavina
aacaggattagataccctggtagtccacgccgtaaacgatgctaactcgtttttggggtttcggcttcagagactaagcgaaagtgataagttagccacctggggagtacgttcgcaagaatgaaactcaaaggaattgacgggggcccgcacaagcggtggattatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctagcattaagttgaggactctagtgagactgcctacgcaagtagagaggaaggtggggatgacgtcaaatcatcacggcccttacgtcttgggccacacacgtaatacaatggccggtacagagggcagctacacagcgatgtgatgcaaatctcgaaagccggtctcagttcggattggagtccgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcctagggtaaaacaggtaactagggctaagtcgtaacaaggtaacc

SEQ ID NO: 349 - DNA, 728 bp, Escherichia coli
aacaggattagataccctggtagtcctagccgtaaacggtgcacgtttgctgtaaaaggaatcgaccccttttgtggcgtagccaacgcgttaaacgcgccgcctgggaagtacggtcgcaagattaaaactcaaagaaattgacgggggcctgcacaagcgatggagtatgtggctcaattcgatgcaacgcgaagaaccttacctggccttgacatgcatatggtagaagggtgaaagcctgacgaggtagcaataccagtatgcacaggtgctgcatggctgtcgtcagctcgtgtcgtgagatgttgggttaagtcccgcaacgagcgcaacccctgtgtcctgttgccacccggtcgcaagactggagcactctggacagactgcctcgcttaaacgaggaggaaggtggggatgacgtcaagtcagtatggcccttacggccagggctgcacacgtactacaatggctggtacaaagggaagctagaccgtcaggtggagcaaatcccccaaaaccagccccagttcagattgtcgtctgcaactcgacggcatgaagctggaatcgctagtaatggcgcatcagctacggcgccgtgaatacgttcccaggccttgtacacaccgcccgtcacatcatgaaagccgtttgtacccgaagtcgttcctcgcgaacgccgaaggtatgaatggtgattgggatgaagtcgtaacaaggtaacc

SEQ ID NO: 350 - DNA, 733 bp, Sphingosinicella xenopeptidilytica
aacaggattagataccctggtagtccgagccgtaaacgatggatactaggtgttggaggtatcgacccctccagtgccgtagctaacgcgttaagtatcccgcctggggagtacggtcgcaagactgaaactcaaaggaattgacgggggcccgcacaagcggtggagcatgtggtttaattcgatgcaacgcgaagaaccttaccaaggcttgacatgtcgagaatcccttagaaataggggagtgccgcaaggagctcgaacacaggtggtgcatggctgtcgtcagctcgtgtcgtgagatgttgggttaagtcccgcaacgagcgcaaccctcgatgtcagttgccaacgggtaaagccgggcactctggcgtgactgccggtgacaaaccggaggaaggtggggatgacgtcaagtcatcatgccccttatgccttgggctacacacgtgctacaatggtcgggacagagggctgcaaagccgcgaggtggagccaatccctaaacccggtctcagttcagattgcaggctgcaactcgcctgcatgaaggcggaatcgctagtaaccgcagatcagcatgctgcggtgaatacgttcccgggccttgtacacaccgcccgtcacaccacgaaagtttgtcacgcccgaagccggtgagccaaccgcaaggaggcagccgtctaaggtggggcagatgattgggggtgaagtcggtaacaaggtaacc

SEQ ID NO: 351 - DNA, 730 bp, Paenibacillus daejeonensis
aacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 352 - DNA, 730 bp, Paenibacillus xylanilyticus
aacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 353 - DNA, 731 bp, Sediminibacillus halophilus
aacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttcgttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 354 - DNA, 733 bp, Corynebacterium pseudogenitalium; identical to SEQ ID NO: 329

SEQ ID NO: 355 - DNA, 730 bp, Nocardia soli
aacaggattagataccctggtagtccacgccgtaaacgatgataactagctgtcggggctcttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatcgctagtaatcgcggatcagcatgccgcggtggatacgttcccaggccttgtacacaccgcccgtcacaccatgggagttggattcacccgaaggcagtgcgctaaccgcaaggaggcagctgaccacggtgggttcagcgactggggtgaagtcgtaacaaggtaacc

SEQ ID NO: 356 - DNA, 732 bp, Lentzea flaviverrucosa
aacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtaacc

SEQ ID NO: 357 - DNA, 730 bp, Flavobacterium degerlachei
aacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttcgttgccagcggttcggccgggaactcgaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 358 - DNA, 730 bp, Flavobacterium aquatile
aacaggattagataccctggtagtccacgccgtaaacgatgataactagctgtcggggctcttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtaacc

SEQ ID NO: 359 - DNA, 730 bp, Chryseobacterium hominis
aacaggattagataccctggtagtccacgccgtaaacgatgataactagctgtccggggacttggtccttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggtaggacggcttccagagatggattccttcccttcggggacctacacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcgtggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgtcgcgctaaccgcaaggaggcaggcgaccacggtgggtttagcgactggggtgaagtcgtaacaaggtaacc

SEQ ID NO: 360 - DNA, 730 bp, Unknown
  Uncultured seed derived bacterium of the family Enterobacteriaceae
aacaggattagataccctggtagtccacgctgtaaacgatgtcgatttggaggttgtgcccttgaggcgtggcttccggagctaacgcgttaagtcgaccgcctggggagtacggccacaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 361 - DNA, 733 bp, Unknown
  Uncultured seed derived bacterium of the family Xanthomonadaceae
aacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacggagtggttcatgactggggtgaagtcgtaacaaggtaacc

SEQ ID NO: 362 - DNA, 725 bp, Klebsiella variicola
aacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaacc

SEQ ID NO: 363 - DNA, 730 bp, Klebsiella pneumoniae
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcatcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 364 - DNA, 726 bp, Pseudomonas plecoglossicida
aacaggattagataccctggtagtccacgccctaaacgatgtcgactggttgttgggccttgagtggctcagtaacgaagctaacgcgtgaagtcgaccgcctggggagtacggccgcaaggttgaaactcaaaggaattgacggggacccgcacaagcggtggatgatgtggtttaattcgatgcaacgcgaaaaaccttacctacccttgacatggcaggaatcctgcagagatgtgggagtgctcgcaagagagcctgcacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttatgggtagggctacacacgtcatacaatggccggtacagagggctgccaacccgcgagggggagccaatccctacaaaaccggtcgtagtccggattgcagtctgcaactcgactgcatgaagtcggaatcgctagtaatcgcggatcagcatgccgcggtgaatacgttcccgggtcttgtacacaccgcccgtcacaccatgggagcgggttctgccagaagtgggtagcctaaccgcaaggagggcgcttaccacggcagggttcgtgactggggtgaagtcgtaacaaggtaacc

SEQ ID NO: 365 - DNA, 730 bp, Stenotrophomonas pavanii
aacaggattagataccctggtagtccacgccgtaaacgatgtcgacttgggggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 366 - DNA, 730 bp, Sphingomonas echinoides
aacaggattagataccctggtagtccacgccgtaaacgatgtcgacttgaaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaacgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 367 - DNA, 732 bp, Rhizobium massiliae
aacaggattagataccctggtagtccacgccctaaacgatgcgaactggatgttgggtgcaacttggcactcagtatcgaagctaacgcgttaagttcgccgcctgggaagtacggtcgcaagactgaaactcaaaggaattgacgggggcccgcacaagcggtggagtatgtggtttaattcgatgcaacgcgcagaaccttacctggccttgacatccagggaaccttgcagagatgcgagggtgccttcgggaaccctgagacaggtgctgcatggctgtcgtcagttcgtgtcgtgagatgttgggttaagtcccgcaacgagcgcaacccttgtccttagttgccagcacttcgggtgggaactctaaggagaccgccggcgacaagccggaggaaggtggggatgacgtcaagtcatcatggcccttacggccagggctacacacgtactacaatggtggggacagagggctgcgaagccgcgaggcggagccaatcccagaaaccccatctcagtccggattggagtctgcaactcgactccatgaagtcggaatcgctagtaatcgcagatcagcattgctgcggtgaatacgttcccgggccttgtacacaccgcccgtcacaccatgggagtctgttgcaccagaagcaggtagcttaaccttcgggagggcgcttgccacggtgtggccgatgactggggtgaagtcgtaacaaggtaacc

SEQ ID NO: 368 - DNA, 730 bp, Serratia marcescens
aacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcgacgcgaagaaccttaccaggtcttgacatccatagccagtctaagagattagatgttcccttcggggactatgagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatggacggtacaacgagaagcgaccctgtgaaggcaagcggatctctgaaagccgttctcagttcggattgcaggctgcaactcgcctgcatgaagctggaatcgctagtaatcgcaaatcagcacgttgcggtgaatacgttcccgggccctgtacacaccgcccgtcacaccatgagagtttgtaacgcccgaagccggcgggataaccgaaaggagtcagccgtctaaggcgggacagatgattagggtgaagtcgtaacaaggtaacc

SEQ ID NO: 369 - DNA, 730 bp, Sphingomonas echinoides
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 370 - DNA, 730 bp, Sphingomonas dokdonensis; identical to SEQ ID NO: 358

SEQ ID NO: 371 - DNA, 731 bp, Pantoea dispersa
aacaggattagataccctggtagtccacgccgtaaacgatgtcgacttggaggttgtgccccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 372 - DNA, 730 bp, Luteibacter anthropi
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaacc

SEQ ID NO: 373 - DNA, 730 bp, Burkholderia gladioli; identical to SEQ ID NO: 358

SEQ ID NO: 374 - DNA, 730 bp, Leclercia adecarboxylata; identical to SEQ ID NO: 358

SEQ ID NO: 375 - DNA, 730 bp, Tepidimonas aquatic
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgggacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctgcacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 376 - DNA, 730 bp, Tatumella morbirosei
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgttgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 377 - DNA, 733 bp, Enterobacter cancerogenus
aacaggattagataccctggtagtccacgccctaaacgatgcgaactggatgttgggttcaacttggaacccagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagttgctgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatgggaaggacagagggctgcaatcccgcgagggggagccgatcccagaaaccttctctcagtccggatcggagtctgcaactcgactccgtgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtaacc

SEQ ID NO: 378 - DNA, 731 bp, Thermomonas brevis
aacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcggtttggccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggttagcctaaccttttaggaaggcgatcaccacggtgtggttgatgactggggtgaagtcgtaacaaggtaacc

SEQ ID NO: 379 - DNA, 729 bp, Lactobacillus iners
aacaggattagataccctggtagtccacgccctaaacgatgtcaactggttgttgggtcttcactgactcagtaacgaagctaacgcgtgaagttgaccgccgggggagtacggccgcaaggttgaaactcaaaggaattgacggggacccgcacaagcggtggatgatgtggtttaattcgatgcaacgcgaaaaaccttacccacctttgacatgtacggaattcgccagagatggcttagtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacataccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtaacc

SEQ ID NO: 380 - DNA, 730 bp, Pantoea dispersa
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagccagcggacctcataaagtacgtcgtagtccggattggagtctgcaactcgactccatgaagtcggaatcgctagtaatcgtagatcagaatgctacggtgaatacgttcccgggccttgtacacactgcccgtcacaccatgggagtgggttgcaaaagaagtaggtagcttaaccttcgggagggcgcttaccactttgtgattcatgactggggtgaagtcgtaacaaggtaacc

SEQ ID NO: 381 - DNA, 732 bp, Sphingomonas echinoides
aacaggattagataccctggtagtccacgccgtaaacgatggatgctagccgttggcgagcttgctcgtcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccaacctttgacatgtccagtatggggaccagagatggaccccttcagttcggctggctggaacacaggtgctgcatggctgtcgtcagctcgtgtcgtgagatgttgggttaagtcccgcaacgagcgcaaccctcgcccttagttgccatcattcagttgggcactctaaggggactgccggtgataagccgcgaggaaggtggggatgacgtcaagtcctcatggcccttacaggttgggctacacacgtgctacaatggcggtgacaatgggcagcgaaggggcgacctggagctaatcccaaaaagccgtctcagttcagattgcactctgcaactcgagtgcatgaaggcggaatcgctagtaatcgtggatcagaacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtaacc

SEQ ID NO: 382 - DNA, 732 bp, Pantoea dispersa
aacaggattagataccctggtagtccacgccgtaaacgatgaatgccagccgttggcgagcttgctcgtcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcctttgacatgtcccgtatgattgccagagatggccttcttcagttcggctggcgggaacacaggtgctgcatggctgtcgtcagctcgtgtcgtgagatgttgggttaagtcccgcaacgagcgcaaccctcgcccctagttgccatcatttggttgggcactctagggggactgccggtgataagccgagaggaaggtggggatgacgtcaagtcctcatggcccttacgggctgggctacacacgtgctacaatggcggtgacaaagggcagcgaacccgcgagggggagctaatcctaaaaagccgtctcagttcagattgcactctgcaactcgagtgcatgaaggcggaatcgctagtaatcgtggatcagaacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtaacc

SEQ ID NO: 383 - DNA, 730 bp, Pantoea agglomerans
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcacggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 384 - DNA, 730 bp, Sphingomonas echinoides
aacaggattagataccctggtagtccacgctgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgcgaaccggagagatccggtgttcccttcggggacgtgcacacaggtgctgcatggctgtcgtcagctcgtgtcgtgagatgttgggttaagtcccgcaacgagcgcaacccacgtcctcagttgccatcattcagttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaactggcaacaggggcaggcgaccacggtagggtcagcgactggggtgaagtcgtaacaaggtaacc

SEQ ID NO: 385 - DNA, 730 bp, Sphingomonas echinoides
aacaggattagataccctggtagtccacgccgtaaacgatgtcgacttggaggttgtgcccttgaggcgtggcttccggagctaacgcgttaagtcgaccgcctggggagtacggccgcaaggttaaaactcagatgaattgacgggggcccgcacaagcggtggagcatgtggtttaattcgatgcaacgcgaagaaccttacctactcttgacatccagagaacttggcagagatgctttggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtagatagcttaaccttcgggagggcgtttaccactttgtgattcatgactggggtgaagtcgtaacaaggtaacc

SEQ ID NO: 386 - DNA, 725 bp, Shigella flexneri
aacaggattagataccctggtagtccacgccctaaacgatgtcaactagttgtcgggtcttcattgacttggtaacgtagctaacgcgtgaagttgaccgcctgggaagtacggtcgcaagattaaaactcaaaggaattgacggggacccgcacaagcggtggatgatgtggattaattcgatgcaacgcggaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttacgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaacc

SEQ ID NO: 387 - DNA, 725 bp, Leclercia adecarboxylata
aacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaacc

SEQ ID NO: 388 - DNA, 725 bp, Pseudoxanthomonas kaohsiungensis
aacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagctaatcccataaagccagtcgtagtccggatcgcagtctgcaactcgactgcgtgaagtcggaatcgctagtaatcgcggatcggaatgtcgcggtgaatacgttcccgggtcttgtacacaccgcccgtcacaccatgggagcgggttctgccagaagtaggtagcctaaccgtaaggagggcgcttaccacggcagggttcgtgactggggtgaagtcgtaacaaggtaacc

SEQ ID NO: 389 - DNA, 730 bp, Psychrobacter pulmonis
aacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 390 - DNA, 730 bp, Variovorax boronicumulans
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttggcagagatgctttggtgccttcgggaactccgagacaggtgctgcatggctgtcgtcagcccgtgttgtgaaatgttgggttaagtcccgcaacgagcgcaacccttatcctttgttgccagcggttcggccgggaactcaaaggagactgccagtgataaactggaggaaggtggggatgacgccaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggtcgcaaaagaagtagatagcttaaccttcgggagggcgtttaccactttgtgattcatgactggggcgaagtcgtaacaaggtaacc

SEQ ID NO: 391 - DNA, 732 bp, Enterobacter sp.
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgaggtgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtggatacgttcccgggccttgtacacaccgcccgtcacaccatgggagtttgttgcaccagaagtaggtagtctaaccgcagggaggacgcttaccacggtgtggccgatgactgggggtgaagtcgtaacaaggtaacc

SEQ ID NO: 392 - DNA, 730 bp, Microvirga aerophilus
aacaggattagataccctggtagtccatgccgtaaacgatgtctactagccgttgggggatttgatcctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtagagactttccagagatggattggtgccttcgggaatctacatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtaacc

SEQ ID NO: 393 - DNA, 731 bp, Microvirga aerilata
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggaatttgttgcaccagaagtaggtagtctaaccgcaaggaggacgcttaccacggtgtggccgatgactggggtgaagtcgtaacaaggtaacc

SEQ ID NO: 394 - DNA, 731 bp, Erwinia aphidicola
aacaggattagataccctggtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtaagaactttccagagatgggttggtgccttcgggaacttacatacaggtgctgcatggctgtcgtcagctcgtgtcgtgaggtgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtaacc

SEQ ID NO: 395 - DNA, 730 bp, Methylobacterium platani
aacaggattagataccctggtagtccacgccgtaaacgatgtcgactagccgttgggtccttcgcggactttgtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctactcttgacatcctgcgaacccttcggagacgaaggggtgccttcgggaacgcagagacaggtgctgcatggctgtcgtcagctcgtgttgtgaaatgttgggttaagtcccgtaacgagcgcaacccttgtccctatttgccagcgattcggtcgggaactctagggagactgccggtgacaaaccggaggaaggtggggacgacgtcaagtcatcatggcccttacgggtaggactacacacgtgctacaatggtcagtacaaagggttgcgaacttgcgagagtgagccaatcccagaaagctgatctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcctaaccttcgggagggcgatcaccacggtgtggttcatgactggggtgaagtcgtaacaaggtaacc

SEQ ID NO: 396 - DNA, 730 bp, Tatumella morbirosei
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 397 - DNA, 730 bp, Burkholderia phytofirmans
aacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcgacgcgaagaaccttaccaggtcttgacatccatagccagtctaagagattagatgttcccttcgggaactatgagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacgcacgtgctacaatggacggtacaacgagaagcgaccctgtgaaggcaagcggatctctgaaagccgttctcagttcggattgcaggctgcaactcgcctgcatgaagctggaatcgctagtaatcgcaaatcagcacgttgcggtgaatacgttcccgggccttgtacacaccgcccgtcacaccatgagagtttgtaacgcccgaagccggcgggataaccgaaaggagtcagccgtctaaggcgggacagatgattagggtgaagtcgtaacaaggtaacc

SEQ ID NO: 398 - DNA, 732 bp, Burkholderia sp.
aacaggattagataccctggtagtccacgccgtaaacgatgagtgctaagtgttagagggtttccgccctttagtgctgcagctaacgcattaagcactccgcctggtgagtacggtcgcaagactgaaactcaaaggaattgacgggggcccgcacaagcggtggagcatgtggtttaattcgaagcaacgcgaagaaccttaccaggtcttgacatcctctgataactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattcccagttcggattgtaagctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtaacc

SEQ ID NO: 399 - DNA, 732 bp, Acidovorax temperans
aacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcgtgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtaacc

SEQ ID NO: 400 - DNA, 732 bp, Serratia marcescens
aacaggattagataccctggtagtccacgccgtaaacgatgagtgctaagtgttaggggggttccgccccttagtgctgcagctaacgcattaagcactccgcctggggattacgaccgcaaggttgaaactcaaaggaattgacggggacccgcacaagcggtggagcatgtggtttaattcgaagcaacgcgaagaaccttaccaaatcttgacatcctctgatccctctagagatagagttttccccttcgggggacagagtgacaggtggtgcatggttgtcgtcagatcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcaaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtaacc

SEQ ID NO: 401 - DNA, 723 bp, Serratia ureilytica
aacaggattagataccctggtagtccacgccgtaaacgatgaatgctaggtgttgggggtcaaacctcggtgccgaagttaacacattaagcattccgcctggggagtacgcacgcaagtgtgaaactcaaaggaattgacggggacccgcacaagcagcggagcatgtggtttaattcgatgcaacgcgaagaaccttaccagggcttgacatgtgggtgaaaggtatagagatatacccctctctttatgagacatccatacaggtggtgcatggttgtcgtcagctcgtgtcgtgagatgttgggttaagtcccgcaacgagcgcaacccctatactcagttaccagcgaataaagtcggggactctaagtagactgccgatgacaaatcggaggaaggtggggatgacgtcaaatcatcatgccctttatgtcctgggctacacacgtgctacaatggttggtacagagggaagctatatagtgatataatgcaaaactccaaagccaatcccagttcggattgtaggctgcaactcgcctacatgaagtcggagttgctagtaatcgcggatcagaatgtcgcggtgaatgcgttcccgggtcttgtacacaccgcccgtcacaccatgggagttgataatacccgaagcctgtgacctaattgaggagcagtcgaaggtaggattgatgactggggtgaagtcgtaacaaggtaacc

SEQ ID NO: 402 - DNA, 727 bp, Acinetobacter beijerinckii
aacaggattagataccctggtagtccacactgtaaacgatgattactaggtgtgggaggtctgaccccttccgtgccgcagttaacgcaataagtaatccacctggggagtacgaccgcaaggttgaaactcaaaggaattgacgggggcccgcacaagcagtggattatgtggtttaattcgaagcaacgcgaagaaccttaccaggtcttgacatccaactaacgaactagagatagattaggtgcccttcggggaaagttgagacaggtggtgcatggttgtcgtcagctcgtgtcgtgagatgttgggttaagtcccgcaacgagcgcaacccctgccattagttgctacgcaagagcactctaatgggaccgctaccgacaaggtggaggaaggtggggacgacgtcaaatcatcatgccccttatgacctgggctacacacgtaatacaatggccgttaacagaaggaagcgaaggcgcgagccggagcaaacccccaaaaacggtctcagttcggattgcaggctgcaactcgcctgtatgaagtcggaattgctagtaatcgcggatcagcatgccgcggtgaatacgttcccgggccttgtacacaccgcccgtcacaccatgggagtttgtaacacccgaagccagtagcctaaccgtaaggagggcgctgtcgaaggtgggataagcgactggggtgaagtcgtaacaaggtaacc

SEQ ID NO: 403 - DNA, 731 bp, Acinetobacter junii
aacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggttcaattcgaagcaacgcgaagaaccttaccaagtcttgacatcctttgaccaccctagagatagggttttcccttcggggacaaagtgacaggtggtgcatggttgtcgtcagctcgtgtcgtgagatgttgggttaagtcccgcaacgagcgcaacccctattattagttgccagcatttagttgggcactctaatgagactgccggtgacaaaccggaggaaggtggggatgacgtcaaatcagcatgccccttatgacttgggctacacacgtgctacaatggatggtacaacgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagccgccgaaggtggcacagatgattggggtgaagtcgtaacaaggtaacc

SEQ ID NO: 404 - DNA, 733 bp, Acinetobacter johnsonii
aacaggattagataccctggtagtccacgccgtaaacggtgggcactaggtgtgggggacattccacgttctccgtgccgtagctaacgcattaagtgccccgcctggggagtacggccgcaaggctaaaactcaaaggaattgacgggggcccgcacaagcggcggagcatgcggatttattcgatgcaacgcgaagaaccttacctgggtttgacatctgccggaagcattcagagatgggtgtgcctttttggtcggttgacaggtggtgcatggctgtcgtcagctcgtgtcgtgagatgttgggttaagtcccgcaacgagcgcaaccctcgtcctatgttgccagtacgtgatggtgggaactcatgggagactgccggggtcaactcggaggaaggtggggatgacgtcaagtcatcatgccccttatgtccagggcttcacgcatgctacaatggctggtacaaagggttgcgatcccgtgagggtgagcgaatcccgtaaagccagtctcagttcggattggggtctgcaactcgaccccatgaagtcggagtcgctagtaatcgcagatcagcattgctgcggtgaatacgttcccgggccttgtacacaccgcccgtcaagtcatgaaagtcggtaacacccgaagccggtggcctaacccttgtggggggagccgtcgaaggtgggatcggtaattaggactaagtcgtaacaaggtaacc

SEQ ID NO: 405 - DNA, 735 bp, Acinetobacter kyonggiensis
aacaggattagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagcgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggcgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtaacc

SEQ ID NO: 406 - DNA, 738 bp, Halomonas daqingensis
aacaggattagataccctggtagtccatgccgtaaacgatgagtgttcgcccttggtctgtctacgctacgctacgcggatcaggggcccagctaacgcgtgaaacactccgcctggggagtacggtcgcaagaccgaaactcaaaggaattgacgggggcctgcacaagcgatggagtatgtggctcaattcgatgcaacgcgaagaaccttacctggccttgacatgcatatggtagaagggtgaaagcctgacgaggtagcaataccagtatgcacaggtgctgcatggctgtcgtcagctcgtgtcgtgagatgttgggttaagtcccgcaacgagcgcaacccctgtgtcctgttgccacccggtcgcaagactggagcactctggacagactgcctcgcttaaacgaggaggaaggtggggatgacgtcaagtcagtatggcccttacggccagggctgcacacgtactacaatggctggtacaaagggaagctagaccgtcaggtggagcaaatcccccaaaaccagccccagttcagattgtcgtctgcaactcgacggcatgaagctggaatcgctagtaatggcgcatcagctacggcgccgtgaatacgttcccaggccttgtacacaccgcccgtcacatcatgaaagccgtttgtacccgaagtcgttcctcgcgaacgccgaaggtatgaatggtgattgggatgaagtcgtaacaaggtaacc

SEQ ID NO: 407 - DNA, 708 bp, Pantoea dispersa
aacaggattagataccctggtagtccacgccgtaaacgatggttgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccacggagacgtggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcaactacagagggttaatccttaaaagttgtctcagttcggattgtcctctgcaactcgagggcatgaagttggaatcgctagtaatcgcggatcagcatgccgcggtgaatacgttcccgggccttgtacacaccgcccgtcacactatgggagttggttctacccgaaggcggtgcgctaaccagcaatggaggcagccgaccacggtagggtcagcgactggggtgaagtcgtaacaaggtaacc

SEQ ID NO: 408 - DNA, 708 bp, Lactobacillus iners
aacaggattagataccctggtagtccacgccgtaaacgatgattgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaactcgcagaaccttaccaccttttgacatgcctggaccgccacggagacgtggctttctcttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggctactacagagggttaatccttaaaagtagtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcggtgcgctaaccagcaatggaggcagccgaccacggtagggtcagcgactggggtgaagtcgtaacaaggtaacc

SEQ ID NO: 409 - DNA, 730 bp, Bacillus aryabhattai; identical to SEQ ID NO: 355

SEQ ID NO: 410 - DNA, 732 bp, Staphylococcus hominis
aacaggattagataccctggtagtccacgccgtaaacgatgataactagctgtctgggggcttagctcttaggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgactttagttaccatcatttagttgggtactctaaagtaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtaacc

SEQ ID NO: 411 - DNA, 733 bp, Staphylococcus capitis
aacaggattagataccctggtagtccacgccgtaaacgatgatgactagctgtcggggcgcttagcgtttcggtggcgcagctaacgcgttaagtcatccgcctggggagtacggccgcaaggttaaaactcaaagaaattgacgggggcctgcacaagcggtggagcatgtggtttaattcgaagcaacgcgcagaaccttaccagcgtttgacatggtaggacggtttctggagacagattccttcccttacgggacctacacacaggtgctgcatggctgtcgtcagctcgtgtcgtgagatgttgggttaagtcccgcaacgagcgcaaccctcgtctttagttgctatcatttagttgggcactctaaagaaactgccggtgataagccggaggaaggtggggatgacgtcaagtcctcatggcccttacgcgctgggctacacacgtgctacaatggcggtgacagagggctgcaaacccgcgagggtgagctaatctccaaaaaccgtctcagttcggattgttctctgcaactcgagagcatgaaggcggaatcgctagtaatcgcggatcagcacgccgcggtgaatacgttcccaggccttgtacacaccgcccgtcacaccatggagttgggttcacccgaaggcgttgcgctaacctcgcaagaggaggcaagcgaccacggtgggcttagcgactggggtgaagtcgtaacaaggtaacc

SEQ ID NO: 412 - DNA, 729 bp, Finegoldia magna
aacaggattagataccctggtagtccacgccctaaacgatgtcaactggttattgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcgtgagatgttgggttaagtcccgcaacgagcgcaacccttgtcattagttgctacatttagttgagcactctaatgagactgccggtgacaaaccggaggaaggtggggatgacgtcaagtcctcatggcccttataggtggggctacacacgtcatacaatggctggtacagagggttgccaacccgcgagggggagccaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtaacc

SEQ ID NO: 413 - DNA, 725 bp, Ruminococcus bromii
aacaggattagataccctggtagtccatgccctaaacgatgtcaactggttgttgggaattcactttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagactgcagagatgcggttgtgctcgaaagagagccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagccaatcccacaaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgcttaccacggcagggttcgtgactggggtgaagtcgtaacaaggtaacc

SEQ ID NO: 414 - DNA, 732 bp, Aerococcus urinaeequi
aacaggattagataccctggtagtccacgccgtaaacgatgaatgttagccgtcggcatgcatgcatgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtcggtcgcggtttccagagatggattccttcagttaggctggaccgaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaagcgatgcgctaaccgcaaggaggcagtcgaccacggtagggtcagcgactggggtgaagtcgtaacaaggtaacc

SEQ ID NO: 415 - DNA, 725 bp, Propioniciclava tarda
aacaggattagataccctggtagtccacgccctaaacgatgtcaactggttgttgggagggtttcttctcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgccaggaatcttgcagagatgtgagagtgctcgaaagagaacctggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtaacc

SEQ ID NO: 416 - DNA, 725 bp, Propionibacterium acnes
aacaggattagataccctggtagtccacgccctaaacgatgtcaactggttgttgggagggtttcttctcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgtcaggaatcttgcagagatgtgagagtgctcgaaagagaacctggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtaacc

SEQ ID NO: 417 - DNA, 731 bp, Unknown
  Uncultured seed derived bacterium of the family Chromatiaceae
aacaggattagataccctggtagtccacgccgtaaacgatgtctactagctgttcgtggtcttgtactgtgagtagcgcagctaacgcactaagtagaccgcctggggagtacggtcgcaagattaaaactcaaatgaattgacgggggcccgcacaagcggtggagcatgtggtttaattcgacgcaacgcgaagaaccttacctactcttgacatctagcgaagattgtagagatacgattgtgccttcgggaacgctaagacaggtgctgcatggctgtcgtcagctcgtgttgtgaaatgttgggttaagtcccgcaacgagcgcaacccttatccttagttgccagcacgtaatggtgggaactctagggagactgccggtgataaaccggaggaaggtggggacgacgtcaagtcatcatggcccttacgagtagggctacacacgtgctacaatggtatgtacagagggaggcaagctggcgacagtgagcggatctcttaaagcatatcgtagtccggatcgcagtctgcaactcgactgcgtgaagtcggaatcgctagtaatcgcaaatcagaatgttgcggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 418 - DNA, 731 bp, Brevundimonas diminuta
aacaggattagataccctggtagtgcacgccgtaaacgatgtctactagctgttcgtggtcttgtactgtgagtagcgcagctaacgcactaagtagaccgcctggggagtacggtcgcaagattaaaactcaaatgaattgacgggggcccgcacaagcggtggagcatgtggtttaattcgacgcaacgcgaagaaccttacctactcttgacatctacggaagactgcagagatgcggttgtgccttcgggaaccgtaagacaggtgctgcatggctgtcgtcagctcgtgttgtgaaatgttgggttaagtcccgcaacgagcgcaacccctatccttagttgccagcacgtaatggtgggaactctagggagactgccggtgataaaccggaggaaggtggggacgacgtcaagtcatcatggcccttacgagtagggctacacacgtgctacaatggtacgtacagagggaggcaagctggcgacagtgagcggatctcttaaagcgtatcgtagtccggatcgcagtctgcaactcgactgcgtgaagtcggaatcgctagtaatcgcaaatcagaatgttgcggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 419 - DNA, 731 bp, Brevundimonas naejangsanensis
aacaggattagataccctggtagtccatgccgtaaacgatgtctactagccgttggggcctttgaggctttagtggcgcagctaacgcgataagcagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccatcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggaatttgttgcaccagaagtaggtagtctaaccgcaaggaggacgcttaccacggtgtggccgatgactggggtgaagtcgtaacaaggtaacc

SEQ ID NO: 420 - DNA, 731 bp, Sphingomonas echinoides
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaatttgatgcaacgcgaagaaccttacctggccttgacatactaagaactttccagagatggattggtgccttcgggaacttagatacaggtgctgcatggctgtcgtcagctcgtgtcgtgagatgttgggttaagtcccgcaacgagcgcaacccttttccttatttgccatcgggtaatgccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtaacc

SEQ ID NO: 421 - DNA, 731 bp, Sphingomonas koreensis
aacaggattagataccctggtagtccatgccgtaaacgatgtctactagccgttggggcctttgaggctttagtggcgcagctaacgcgataagtagaccgcctgaggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggagggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggcagatgactggggtgaagtcgtaacaaggtaacc

SEQ ID NO: 422 - DNA, 731 bp, Sphingomonas humi
aacaggattagataccctggtagtccacgccgtaaacgatgtcgaccagccgttgggatccttgagatcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgccagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgaccgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtaacc

SEQ ID NO: 423 - DNA, 733 bp, Acidovorax facilis
aacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgcacggaactttccagagatggattggtgccttcgggaaccgtgacacaggtgctgcatggctgtcgtcagctcgtgtcgtgagatgttgggttaagtcccgcaacgagcgcaacccttgtccttagttgccagcacgtaatggtgggaactctaaggagaccgccggcgacaagccggaggaaggtggggatgacgtcaagtcatcatggcccttacggccagggctacacacgtactacaatggtggggacagagggttgcgataccgcgaggtggagccaatctcagaaaccccatcccagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccgcaaggggggcgcttgccacggtgtggccgatgactggggtgaagtcgtaacaaggtaacc

SEQ ID NO: 424 - DNA, 725 bp, Acidovoraz temperans
aacaggattagataccctggtagtccacgccctaaacgatgtcaactagttgttggggattcatttccttagtaacgtagctaacgcgtgaagttgaccgcctggggagtacagtcgcaagattaaaactcaaaggaattgacggggacccgcacaagcggtggatgatgtggattaattcgatgcaacgcgagaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaacc

SEQ ID NO: 425 - DNA, 730 bp, Shinella zoogloeoides
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatcctcggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 426 - DNA, 731 bp, Roseateles depolymerans
aacaggattagataccctggtagtccacgccgtaaacgatgtctactagccgttgggagccttgagctcttagtggcgcagctaacgcactaagtagaccgcctggggagtacggtcgcaagattaaaactcaaatgaattgacgggggcccgcacaagcggtggagcatgtggtttaattcgacgcaacgcgaagaaccttaccaggtcttgacatccagagaactttccagagatggattggtgccttcgggaactctgagacaggtgctgcatggctgtcgtcagctcgtgtcgtgagatgttgggttaagtcccgtaacgagcgcaacccttgtccttagttgccagcgcgtaatggcgggaactctaaggagactgccggtgacaaaccggaggaaggtggggatgacgtcaagtcatcatggcccttacgacctgggctacacacgtgctacaatgggcggtacaaagggttgccaaaccgcgaggtggagctaatcccgtaaaaccgttcgtagtccggattggagtctgcaactcgactccatgaagtcggaatcgctagtaatcgcaaatcagaacgttgcggtgaatacgttcccgggccttgtacacaccgcccgtcacaccatgggagtgggttgcaaaagaagtagctagtctaaccgcaagggggacggttaccactttgtgattcatgactggggtgaagtcgtaacaaggtaacc

SEQ ID NO: 427 - DNA, 730 bp, Roseateles terrae; identical to SEQ ID NO: 389

SEQ ID NO: 428 - DNA, 725 bp, Rheinheimera chironomi
aacaggattagataccctggtagtccacgccctaaacgatgtcaactggctgttgggtgcgagagtactcagtagcgaagctaacgcgtgaagttgaccgcctggggagtacggccgcaaggttgaaactcaaaggaattgacgggggcccgcacaagcggtggatgatgtggattaattcgatgcaacgcgaagaaccttacctgctcttgacatgccaggaactttccagagatggattggtgcccgaaagggaacctggacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttatgagcagggcttcacacgtcatacaatggtcggtacagagggtagccaacccgcgagggggagccaatcccagaaaaccgatcgtagtccggattgcagtctgcaactcgactgcatgaagtcggaatcgctagtaatcgcaggtcagcatactgcggtgaatacgttcccgggccttgtacacaccgcccgtcacaccatgggagtaggttgctccagaagtaggtagcctaaccgcaaggggggcgcttaccacggagtgattcatgactggggtgaagtcgtaacaaggtaacc

SEQ ID NO: 429 - DNA, 733 bp, Rheinheimera soli
aacaggattagataccctggtagtccacgccctaaacgatgcgaactggatgttgggtgcaactaggcactcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgcacggaactttccagagatggattggtgccttcgggaaccgtgacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatgggaaggacagagggctgcaatcccgcgagggggagccaatcccagaaaccttctctcagtccggatcggagtctgcaactcgactccgtgaagtcggaatcgctagtaatcgcagatcagcattgctgcggtgaatacgttcccgggccttgtacgcaccgcccgtcacaccatgggagtgggttgcaccagaagtagctagtctaaccttcgggaggacggttaccacggtgtgattcatgactggggtgaagtcgtaacaaggtaacc

SEQ ID NO: 430 - DNA, 734 bp, Acinetobacter johnsonii
aacaggattagataccctggtagtccacgccgtaaacgatgataactagctgtcggggcccatagggtttcggtggcgcagctaacgcattaagttatccgcctggggagtacggccgcaaggttaaaactcaaagaaattgacgggggcctgcacaagcggtggagcatgtggtttaattcgaagcaacgcgcagaaccttaccagcgtttgacatcctcatcgcgggatccagagatggattccttcagttcggctggatgagtgacaggtgctgcatggctgtcgtcagctcgtgtcgtgagatgttgggttaagtcccgcgacgagcgcaaccctcgtccttagttgccatcatttagttgggcactctaaggaaaccgccggtgataagccggaggaaggtggggatgacgtcaagtcctcatggcccttacgcgctgggctacacacgtgctacaatggcggtgacagtgggcagcaaacccgcgagggtgagctaatctccaaaagccgtctcagttcggattgttctctgcaactcgagagcatgaaggcggaatcgctagtaatcgcggatcagcacgccgcggtgaatacgttcccaggccttgtacacaccgcccgtcacaccatgggagttggattgacccgaaggcgctgagctaacccgcaagggaggcaggcgaccacggtcggttcagcgactggggtgaagtcgtaacaaggtaacc

SEQ ID NO: 431 - DNA, 732 bp, Acinetobacter schindleri
aacaggattagataccctggtagtccacgccctaaacgatgaatactagatgtttggtgccaagcgtactgagtgtcgtagctaacgcgataagtattccgcctgggaagtacggccgcaaggttaaaactcaaaggaattgacgggggcccgcacaagcggtggagcatgtggtttaattcgatgcaacgcgaagaaccttacctgggcttgacatgtctggaatcctgcagagatgcgggagtgcccttcggggaatcagaacacaggtgctgcatggctgtcgtcagctcgtgtcgtgagatgttgggttaagtcccgcaacgagcgcaacccttgtccttagttgccagcggttcggccgggcactctagggagactgccggtgacaaaccggaggaaggtggggatgacgtcaagtcctcatggcctttatgtccagggctacacacgtgctacaatggcgcgtacagagggaagccaagccgcgaggtggagcagaccccagaaagcgcgtcgtagttcggattgcagtctgcaactcgactgcatgaagtcggaatcgctagtaatcgcggatcagcatgccgcggtgaatacgttcccgggccttgtacacaccgcccgtcacaccatgggagtggattgtaccagaagccgttagcctaaccttcgggagggcgatgaccacggtatggttcatgactggggtgaagtcgtaacaaggtaacc

SEQ ID NO: 432 - DNA, 725 bp, Acinetobacter lwoffii
aacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagttaccagagatggtttcgtgctcgaaagagaaccgtaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttataggtggggctacacacgtcatacaatggctggtacagagggttgccaacccgcgagggggagctaatcccataaaaccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtaacc

SEQ ID NO: 433 - DNA, 729 bp, Pseudomonas stutzeri
aacaggattagataccctggtagtccacgccgtaaactatgagagctagccgttggagggtttacccttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggcaggacgacttccagagatggatttcttcccttcggggacctgcacacaggtgctgcatggctgtcgtcagctcgtgtcgtgagatgttgggttaagtcccgcaacgagcgcaaccctcgcctttagttgccatcattcagttgggcactctagagggattgccggtgataagccggaggaaggtggggatgacgtcaagtcttcatggcccttacgggctgggctacacacgtgctacaatggcggtgacagagggttgctacacagcgatgtgatgctaatcccaaaaagccgtctcagttcggattgcactctgcaactcgagtgcatgaagtcggaatcgctagtaaccgcagatcagcacgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtaacc

SEQ ID NO: 434 - DNA, 726 bp, Thermomonas koreensis
aacaggattagataccctggtagtccacgccctaaacgatgtcaactggttgttgggagggtttcttctcagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcatcaggtgcccgaaagggaaagtggacacaggtgctgcatggctgtcgtcagctcgtgtcgtgagatgttgggttaagtcccgcaacgagcgcaacccttgtctctagttgctacgcaagggcactctagagagactgccggtgacaaaccggaggaaggtggggatgacgtcaagtcctcatggcccttatgggtagggcttcacacgtcatacaatggtgcgtacagagggttgccaacccgcgagggggagctaatcccagaaaacgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttgccagaagtagttagcctaaccgcaaggagggcgattaccacggcagggttcatgactggggtgaagtcgtaacaaggtaacc

SEQ ID NO: 435 - DNA, 728 bp, Burkholderia sp.
aacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttagctcgagagatcgggtgtcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagagggacgcgaaaccgcgaggttgagcaaatccccaaaagccgtctcagttcggattgcactctgcaactcgggtgcatgaaggcggaatcgctagtaatcgtggatcagcacgccacggtgaatacgttcccgggccttgtacacactgcccgtcacaccatgggagttggtcttacccgacggcgctgcgccaaccgcaaggaggcaggcgaccacggtagggtcagcgactggggtgaagtcgtaacaaggtaacc

SEQ ID NO: 436 - DNA, 733 bp, Shigella flexneri
aacaggattagataccctggtagtccacgccctaaacgatgcgaactggacgttgggcacacttaggtgctcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcacgtaatggtgggaactctaaggagactgccggtgacaaaccggaggaaggtggggatgacgtcaagtcatcatggcccttacggccagggctacacacgtactacaatggtcggtacagagggttgcaaagccgcgaggtggagccaatcccagaaagccgatctcagtccggatcggagtctgcaactcgactccgtgaagtcggaatcgctagtaatcgcggatcagcattgtcgcggtgaatacgttcccgggccttgtacacaccgcccgtcacaccatgggagtgggttgctccagaagcaggtagcgtaaccgcaaggagcgcgcttgccacggagtggttcatgactggggtgaagtcgtaacaaggtaacc

SEQ ID NO: 437 - DNA, 730 bp, Cellvibrio mixtus
aacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattattagttgccagcattcagttgggcactctagtgagactgccggtgataaaccggaggaaggtggggatgacgtcaaatcatcatgccccttatgacctgggctacacacgtgctacaatggatggtacaacgagtcgcaaaaccgcgaggttaagctaatctcttaaagccattctcagttcggattgtaggctgcaattcgcctacatgaagccggaatcgctagtaatcgcggatcagaacgccgcggtgaatacgttcccgggccttgtacacaccgcccgtcacaccacgagagtttgtaacacccaaagtcggtgaggtaaccttcgggagccagccgcctaaggtgggacagataattggggtgaagtcgtaacaaggtaacc

SEQ ID NO: 438 - DNA, 736 bp, Serratia marcescens
aacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacattcaccggaccgccccagagatggggtttcccttcggggctggtggacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcacgaaagttggtaacacccgaagccggtggcctaaccccctgtgggagggagccgtcgaaggtgggactggcgattgggactaagtcgtaacaaggtaacc

SEQ ID NO: 439 - DNA, 735 bp, Thiobacillus aquaesulis
aacaggattagataccctggtagtccatgccgtaaacggtgggtactaggtgtggggctccttccacggactccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatacaccagaaagccgtagagatacggccccccttgtggttggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtaacc

SEQ ID NO: 440 - DNA, 736 bp, Luteimonas aestuarii
aacaggattagataccctggtagtccacgccgtaaacggtgggcgctaggtgtgggggccattccacggtctctgtgccgcagctaacgcattaagcgccccgcctggggagtacggccgcaaggctaaaactcaaaggaattgacgggggcccgcacaagcggcggagcatgtggattaattcgatacaacgcgaagaaccttacctgggtttgacatgcaccagacgcgtccagagatgggcgttcccttgtggctggtgtgcaggtggtgcatggctgtcgtcagctcgtgtcgtgagatgttgggttaagtcccgcaacgagcgcaaccctcgttccatgttgccagcgggttatgccggggactcatgggagactgccggggtcaactcggaggaaggtggggatgacgtcaagtcatcatgccccttatgtccagggcttcacacatgctacaatggcctatacagagggctgcgagaccgcaaggtggagcgaatcccttaaagtaggtctcagttcggatcggggtctgcaactcgaccccgtgaagttggagtcgctagtaatcgcagatcagcaacgctgcggtgaatacgttcccgggccttgtacacaccgcccgtcacgtcacgaaagttggtaacacccgaagccgacggcctaacccgcttgcgggagggagttgtcgaaggtgggactggcgattgggacgaagtcgtaacaaggtaacc

SEQ ID NO: 441 - DNA, 714 bp, Sphingosinicella sp.
aacaggattagataccctggtagtccacgccgtaaacgatggatactagctgttgggggcaacttcagtggctaagcgaaagtgataagtatcccacctggggagtacgaacgcaagtttgaaactcaaaggaattgacgggggcccgcacaagcggtggagcatgtggtttaattcgatgatacgcgaggaaccttaccaaggcttaaatgcagactgaccgatttggaaacagatctttcgcaagacagtttacaaggtgctgcatggttgtcgtcagctcgtgccgtgaggtgtcaggttaagtcctataacgagcgcaacccctgttgttagttgccagcgagtagtgtcgggaactctaacaagactgccagtgcaaactgtgaggaaggtggggatgacgtcaaatcatcacggcccttacgccttgggctacacacgtgctacaatggccggtacagagagcagccactgggtgaccaggagcgaatctataaagccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtaacc

SEQ ID NO: 442 - DNA, 719 bp, Acidithiobacillus albertensis
aacaggattagataccctggtagtccacgccctaaacgatgatgactcgatgtttgcgatataccgtaagcgtccaagcgaaagcgttaagtcatccacctggggagtacgcccgcaagggtgaaactcaaaggaattgacgggggcccgcacaagcggaggaacatgcggtttaattcgatgatacgcgaggaaccttacccgggcttgaaagttactgaagggcgcagagacgcgcccgtccttcgggacaggaaactaggtgctgcatggctgtcgtcagctcgtgccgtgaggtgttgggttaagtcccgcaacgagcgcaacccctatgtttagttgccagcacgtcaaggtggggactctaaacagactgcctgcgcaagcagagaggaaggcggggacgacgtcaagtcatcatggcccttacgtccggggctacacacgtgctacaatggatgatacagcgggcagctacacagcaatgtgatgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagctatgaaagctgggggtacctaaagcatgtaaccgcaaggagcgtgtcagggtaagaccggtaattgggggctaagtcgtaacaaggtaacc

SEQ ID NO: 443 - DNA, 721 bp, Curvibacter gracilis
aacaggattagataccctggtagtccacgccctaaacgatggatactcgacatacgcgatacactgtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgcagtctgaccgtgggtgaaagctcattttgtagcaatacacagattgtaaggtgctgcatggctgtcgtcagctcgtgccgtgaggtgttgggttaagtcccgcaacgagcgcaacccccatcagtagttgccatcaggtaacgctgggaactctactgaaactgccgtcgtaagacgcgaggaaggaggggatgatgtcaagtcatcatggcctttatgcccagggctacacacgtgctacaatggggcgtacaaagggctgccacttagcgataaggagccaatcccaaaaaacgcctctcagttcagatcgcagtctgcaactcgactgcgtgaagctggaatcgctagtaatcgtatatcagcaatgatacggtgaatacgttcccggaccttgcacacaccgcccgtcaagccatggaagccgggtgtacctaaagtcggtaaccgcaaggagccgcctagggtaaaactggtaactggggctaagtcgtaacaaggtaacc

SEQ ID NO: 444 - DNA, 718 bp, Devosia insulae
aacaggattagataccctggtagtccacgccctaaacgatgatgactcgatgtttgcgatataccgtaagcgtccaagcgaaagcgttaagccatccacctggggagtacgcccgcaagggtgaaactcaaaggaattgacgggggcccgcacaagcggaggagcatgtggtttaattcgatgatacgcgaggaaccttacccgggcttgaaagttactgaagcatccagagacggatgcgtccttcgggacaggaaactaggtgctgcatggctgtcgtcagctcgtgccgtgaggtgttgggttaagtcccgcaacgagcgcaacccctatgtccagttgccagcacgtaatggtggggactctggccagactgcctgcgcaagcagagaggaaggcggggacgacgtcaagtcatcatggcccttacgtccggggctacacacgtgctacaatggatggtacagcgggcagctacacagcaatgtgatgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagctgggggtacctaaagcatgtaaccgcaaggagcgtgtcagggtaaaaccggtaattggggctaagtcgtaacaaggtaacc

SEQ ID NO: 445 - DNA, 730 bp, Cupriavidus gilardii
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 446 - DNA, 730 bp, Methylobacterium rhodesianum
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 447 - DNA, 476 bp, Dokdonella sp.
tggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcacctgacggtacct

SEQ ID NO: 448 - DNA, 480 bp, Desemzia incerta
tggctcaggacgaacgctggcggcgtgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtacctgacggtacctaacc

SEQ ID NO: 449 - DNA, 483 bp, Kocuria rosea
tctgctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcacctgacggtacctacc

SEQ ID NO: 450 - DNA, 777 bp, Nocardia ignorata
tgagtaacacgtaggcaacctgccctcaagtttgggacaactaccggaaacggtagctaataccgaatagttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactcc

SEQ ID NO: 451 - DNA, 482 bp, Pseudonocardia aurantiaca
tggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatctgacggtacctaatca

SEQ ID NO: 452 - DNA, 935 bp, Flavobacterium johnsoniae
  misc_feature 481: N is A,T,C or G
ctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcttacgggaggcagcagtggggaatattgcacaatgggcgcaagcctgatgcagccatgccgcgtgtatgaagaaggccttcgggttgtaaagtactttcagcggggaggaaggcgatgtggttaataaccgcatcgattgacgttacccgcagaagaagcaccggctaactccgtgccagcagccgcggtaatacggagggtgcaagcgttaatcggaattactgggcntaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttgg

SEQ ID NO: 453 - DNA, 939 bp, Flavobacterium mizutaii
  misc_feature 387, 425: N is A,T,C or G
ctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcatngattgacgttaccccgcagaagaagcaccggctaactnccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtg

SEQ ID NO: 454 - DNA, 850 bp, Flavisolibacter ginsengiterrae
  misc_feature 792, 839: N is A,T,C or G
ggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcntggggagtacggccgcaaggctgaaactcaaaggaattgacgggggnccgcacaagcg

SEQ ID NO: 455 - DNA, 907 bp, Sphingobacterium daejeonense
tggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggttt

SEQ ID NO: 456 - DNA, 911 bp, Leclercia adecarboxylata
gttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgaca

SEQ ID NO: 457 - DNA, 919 bp, Enterobacter cancerogenus
gcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacac

SEQ ID NO: 458 - DNA, 872 bp, Bacillus altitudinis
  misc_feature 123: N is A,T,C or G
gggtgcgtaacgcgtgggaatctgccctttggttcggaataacagctggaaacggctgctaataccggatgatgacgaaagtccaaagatttatcgccagaggatgagcccgcgttggattangtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatgga

SEQ ID NO: 459 - DNA, 819 bp, Bacillus simplex
  misc_feature 46: N is A,T,C or G
ggctgctaataccggatgatgacgaaagtccaaagatttatcgccngaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatgga

SEQ ID NO: 460 - DNA, 919 bp, Bacillus thuringiensis
ggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggc

SEQ ID NO: 461 - DNA, 888 bp, Paenibacillus amylolyticus
cgggtgagtacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcctgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttccag

SEQ ID NO: 462 - DNA, 914 bp, Staphylococcus aureus subsp. aureus
  misc_feature 76: N is A,T,C or G
acgggtgagtaacacgtgggtaacctgcccataagactgggataactccgggaaaccggggctaataccggataanattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccc

SEQ ID NO: 463 - DNA, 889 bp, Pantoea ananatis
gagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttctttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtc

SEQ ID NO: 464 - DNA, 882 bp, Pantoea ananatis
  misc_feature 802: N is A,T,C or G
cgggtgagtacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcntggctgaaactcaaaggaattgacgggggcccgcacaagcggtggagcatgtggtttaattcgaagcaacgcgaagaacc

SEQ ID NO: 465 - DNA, 899 bp, Bacillus cereus
ggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtc

SEQ ID NO: 466 - DNA, 899 bp, Pantoea ananatis
  misc_feature 88, 89, 94: N is A,T,C or G
ggcggacgggtgagtaacacgtgggtaacctgcccataagactgggataactccgggaaaccggggctaataccggataacattttgnnctgcntggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtc

SEQ ID NO: 467 - DNA, 931 bp, Bacillus cereus
  misc_feature 244: N is A,T,C or G
gggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctnctggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctcct

SEQ ID NO: 468 - DNA, 927 bp, Sphingomonas echinoides
gcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagaga

SEQ ID NO: 469 - DNA, 938 bp, Sphingomonas echinoides
ggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctcct

SEQ ID NO: 470 - DNA, 925 bp, Sphingomonas echinoides
ggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagaga

SEQ ID NO: 471 - DNA, 918 bp, Sphingomonas parapaucimobilis
gttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctg

SEQ ID NO: 472 - DNA, 921 bp, Bacillus cereus
gcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccc

SEQ ID NO: 473 - DNA, 925 bp, Bacillus cereus
gttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccc

SEQ ID NO: 474 - DNA, 937 bp, Bacillus cereus
ggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctcc

SEQ ID NO: 475 - DNA, 925 bp, Bacillus cereus; identical to SEQ ID NO: 470

SEQ ID NO: 476 - DNA, 923 bp, Bacillus cereus
tagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccc

SEQ ID NO: 477 - DNA, 925 bp, Bacillus cereus; identical to SEQ ID NO: 470

SEQ ID NO: 478 - DNA, 747 bp, Bacillus cereus
gaatacatcggaatctaccttttcgtggggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagc

SEQ ID NO: 479 - DNA, 611 bp, Bacillus cereus
  misc_feature 91: N is A,T,C or G
tctcactatcggatgaacccagatgggattagctagtaggcggggtaacggcccacctaggcgacgatccctagctggtctgagaggatgnccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcattgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgac

SEQ ID NO: 480 - DNA, 662 bp, Bacillus cereus
gtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgac

SEQ ID NO: 481 - DNA, 550 bp, Bacillus cereus
aaagtttttctgccgaaggatcggcccgcgtctgattagctagttggtgaggttatggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactgattggcttgagaccggaagaggacagcggaactgcgagtgtagaggtgaaattcgtagatattcgcaagaacaccagtggcgaaggcggctgtctggtccggttctgacgctgaggcgcgaaagcgtggggggcaaac

SEQ ID NO: 482 - DNA, 567 bp, Bacillus cereus
tctgccgaaggatcggcccgcgtctgattagctagttggtgaggttatggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactgattggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccac

SEQ ID NO: 483 - DNA, 584 bp, Bacillus cereus
  misc_feature 458, 459, 460: N is A,T,C or G
gtaaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactnnnctggtattgacgctgaggtgcgaaagcgtggggagcaaacaggattagataccctggtagtccacgccgtaaacgatgataactagctgtccggggacttggtctttgggtggcgcagctaacg

SEQ ID NO: 484 - DNA, 657 bp, Bacillus cereus
tctgccctttggttcggaataacagctggaaacggctgctaataccggatgatgacgagagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataac

SEQ ID NO: 485 - DNA, 613 bp, Bacillus cereus
cccagaggatgagccccgcgttggattaggtagttggtggggtaaaggcctaccaagccgacgattccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtg

SEQ ID NO: 486 - DNA, 596 bp, Bacillus cereus
actgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggt

SEQ ID NO: 487 - DNA, 572 bp, Bacillus cereus
  misc_feature 73: N is A,T,C or G
ggattagctagtaggcggggtaacggcccacctaggcgacgatccctagctggtctgagaggatgaccagccncactggaactgagacacggtccagactcctacgggaggcagcagtggggaatattgcacaatgggcgcaagcctgatgcagccatgccgcgtgtatgaagaaggccttcgggttgtaaagtactttcagcggggaggacggcgatgtggttaataaccgcattgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccg

SEQ ID NO: 488 - DNA, 600 bp, Bacillus cereus
  misc_feature 60, 264: N is A,T,C or G
cctctcactatcggatgaaccccagatgggattagctagtaggcggggtaacggcccacntaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcatngattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccg

SEQ ID NO: 489 - DNA, 571 bp, Xanthomonas translucens
  misc_feature 353: N is A,T,C or G
cacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagcngaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactcc

SEQ ID NO: 490 - DNA, 702 bp, Pantoea ananatis
agactgggataactcccgggaacccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagt

SEQ ID NO: 491 - DNA, 747 bp, Pantoea ananatis
  misc_feature 154: N is A,T,C or G
cctgtaagacttggataactcccggaaaccggggctaatacccggatggttgtttgaaccgcatggttcaaacataaaaggtggcttcggctaccacttacagatggacccgcggcgcattagctagttggtgaggtaacggctcaccaaggcnacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgca

SEQ ID NO: 492 - DNA, 706 bp, Methylobacterium aquaticum
  misc_feature 133: N is A,T,C or G
tccgggaaaccgggctaataccggatggttgtttgaaccgcatggttcaaacataaaaggtggcttcggctaccacttacagatggacccgcggcgcattagctagttggtgaggtaacggctcaccaaggcnacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgcccc

SEQ ID NO: 493 - DNA, 678 bp, Methylobacterium aquaticum
aacctgcctgtaagactgggataacttccggaaacccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagatacc

SEQ ID NO: 494 - DNA, 699 bp, Sphingomonas melonis
ttctgggataagcctgggaaactaggttttaataccggataggagcgcctaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgc

SEQ ID NO: 495 - DNA, 600 bp, Sphingomonas yabuuchiae
  misc_feature 44, 90: N is A,T,C or G
aagtccaaagatttattcgccagaggatgagccccgcgttggantaggtagttggtggggtaaaggcctaccaagccgacgatccatagntggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagttgaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgaaac

SEQ ID NO: 496 - DNA, 619 bp, Sphingomonas yabuuchiae
  misc_feature 98, 522, 523, 524, 527, 528: N is A,T,C or G
tgacgaaagtccaaagatttatcgcccagagggatgagcccgcgttggatttaggtagttggtgggtaaaggcctaccaagccgacgatccatagctngtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactnnnctnntattgacgctgaggtgcgaaagcgtggggagcaaacaggattagataccctggtagtccacgccgtaaacgatgataactagctgtccggg

SEQ ID NO: 497 - DNA, 1046 bp, Methylobacterium aquaticum
tggtagattgaacgctggcggcatgccttacacatgcaagtcgaacggtaacaggtcttcggatgctgacgagtggcgaacgggtgagtaatacatcggaacgtgcccaagagtgggggataacggagcgaaagctttgctaataccgcatacgatctacggatgaaagcaggggaccgcaaggccttgcgctcatggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagcctctttctaataaagagggtcatgacggtaccgtaagaataagcaccggctaactacgtgccagcagccgcggtaatacgtagggtgcgagcgttaatcggaattactgggcgtaaagcgtgcgcaggcggtaatgtaagacagatgtgaatccccgggctcacctgggaactgcatttgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcg

SEQ ID NO: 498 - DNA, 588 bp, Pantoea ananatis
actgccggccgcatggtctggtggtggaaagattttttggttggggatggactcgcggcctatcagcttgttggtgaggtaatggctcaccaaggcgacgacgggtagccggcctgagaggggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggat

SEQ ID NO: 499 - DNA, 675 bp, Pantoea ananatis
aactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacaca

SEQ ID NO: 500 - DNA, 601 bp, Bacillus subtilis
  misc_feature 210: N is A,T,C or G
cccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcatngattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacg

SEQ ID NO: 501 - DNA, 602 bp, Bacillus subtilis
  misc_feature 43, 206: N is A,T,C or G
cttagggcgaccgatccctagctggtttgagaggatgaccagncccccctggaactgagacacgttccagactcatacgggaggcagcagtggggaatattgcacaatggggcgcaagcctgatgcagccatgccgcgtgtatgaagaaggccttcgggttgtaaagtactttcagcggggaggaaggcgatgtggttaataaccncatggattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacag

SEQ ID NO: 502 - DNA, 691 bp, Bacillus subtilis
  misc_feature 66: N is A,T,C or G
ccggatagttccttgaaccgcatggtttcaaggatgaaagacggtttcggctgtcacttacagatngacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagt

SEQ ID NO: 503 - DNA, 746 bp, Bacillus subtilis
  misc_feature 351, 355: N is A,T,C or G
ttctgggatctgcccgatagagggggataaccactggaaaccggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccncatngattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacg

SEQ ID NO: 504 - DNA, 606 bp, Bacillus pumilus
cccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgta

SEQ ID NO: 505 - DNA, 705 bp, Micrococcus luteus
  misc_feature 62: N is A,T,C or G
ccggagctaataccggatagttccttgaaccgcatggttcaaggatgaaagacggtttcggnctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagttc

SEQ ID NO: 506 - DNA, 780 bp, Sphingomonas yabuuchiae
gtggtggattagtggcgaaccggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctg

SEQ ID NO: 507 - DNA, 556 bp, Sphingomonas yabuuchiae
  misc_feature 23, 72: N is A,T,C or G
ccaaggcgacgatccgtagctgntgtgagaggatgatcagccacactggaactgagacacggtccagactcntacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaac

SEQ ID NO: 508 - DNA, 649 bp, Acidovorax sp.
catggtttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgt

SEQ ID NO: 509 - DNA, 574 bp, Curtobacterium flaccumfaciens
  misc_feature 39: N is A,T,C or G
ttcgggcttcgcgcggatagatgagccgatgtcggattngctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaa

SEQ ID NO: 510 - DNA, 1362 bp, Paenibacillus amylolyticus
accatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagcagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggataagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacgt

SEQ ID NO: 511 - DNA, 1415 bp, Pantoea ananatis
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagactaagcaccggctaacttcgtgccagcagccgcggtaatacgaagggtgcaagcgttaatcggaattactgggcgtaaagcgcgcgtaggtggcttgataagttgggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgccttgatgcttacctggccttgacatgctgagaacctttcagagatggatacgtgccttcgggaactctcagactcgtgctgcatggctgtcgtcagctcgtgtcgtgagatgttgggttaagtcccgatacgagcgcaacggtactggtaagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacga

SEQ ID NO: 512 - DNA, 1415 bp, Pantoea ananatis
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacggggggcccgcacaagcggtggagcatggtggtttaattcgaagcaacgcgaagtaccttacctggccttgacatgctgagaaccttgcagagatggattggtgccttcgggaactcagacacaggtgctgcatggctgtcgtcagctcgtgtcgtgagatgttgggttaagtcccgtaacgagcgcaacccttgtccttagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacg

SEQ ID NO: 513 - DNA, 1418 bp, Bacillus pumilus
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagatgcttacctggccttgacatgctgagaacattgcagagatggatatgtgccttcgggaactcagacacaggtgctgcatggctgtcgtcagctcgtgtcgtgagatgttgggttaagtcccgtaacgagcgcaacccttgtccttagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacggagta

SEQ ID NO: 514 - DNA, 1401 bp, Pantoea ananatis
taccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagcttacgcattaagcgccccgcctggggagtacggccgcaaggctaaaactcaaaggaattgacgggggcccgcacaagcggcggagcatgcggattaattcgatgcaacgcgaagaagcttaccaaggcttgacatacaccggaaacggccagagatggttggccccttgtggtcggtgtacaggtggtgcatggatgtcgtcagctcgtgtcgtgacatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaagt

SEQ ID NO: 515 - DNA, 1407 bp, Xanthomonas translucens
catgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgttctagcttacctggccttgacatgctgagaacattgcagagatgctatgctgccttccgggactcagacacaggtgctgcatggctgtcgtcagctcgtgtcctgagatgatcggttaagtcccgtaacgagcgcaacccttgtccttagtatccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtacc

SEQ ID NO: 516 - DNA, 1388 bp, Bacillus pumilus
ccatgcagtcgaacggcagcacagaatagcttgctctttgggtggcgagtggcggacgggtgagtaatgtctgggaaactgcccgatggagggggataactactggaaacggtagctaataccgcataacgtcgcaagaccagagtgggggaccttcgggcctcacgccatcggatgtgcccaaatgggattagctagtaggtggggtaatggctcacctaggcgacgatccctagctggtctgagaggatgaccagccacactggaactgagacacggtccatactcctacgggaggcggcaatggggaatattggacaatgggcgcaagcctgatgcacccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaacgcggccccctggaccaacactgacgctcacgtgcgatagcgtggggagcaaacaggattacataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactatgagacaggtgctgcatggccgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggta

SEQ ID NO: 517 - DNA, 1422 bp, Curtobacterium flaccumfaciens
accatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatggtaggtttaattcgatgcaacgcgttctaccttacctggtcttgacatccacggaaccttgcagagatggattggtgcctttcggtagcgtgagacacgtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacg

SEQ ID NO: 518 - DNA, 1358 bp, Xanthomonas translucens
aagcagtcgagcggacctttcggggtcagcggcggacgggtgagtaacgcgtgggaacgtgccttccggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggttgaaagcctgtggctcaacccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggcgagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgtccac

SEQ ID NO: 519 - DNA, 1422 bp, Bacillus pumilus
catgcagtcgaacggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccggcggtaatacggaggggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtgggagtatgtggtttaattcgatgcaacgcgaagaaccttacctgggcatgacatgtccggaatcctgcagagatgcgggagtgccttcgggaatcggaacacagctgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacg

SEQ ID NO: 520 - DNA, 1356 bp, Xanthomonas translucens
catgcagtcgaacgcatcgcagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcagaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattgggagacgatgaccttcagttcggctggccctagaacaggtgctgcatggctgtcgtcagctcgtgtcgtgagatgttgggataagtcccgcaacgagcgcaaccctcccgcatagttggcagcatttagttgggctctctatcgggactgccggtgatatccgcagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgacc

SEQ ID NO: 521 - DNA, 1420 bp, Agrobacterium sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcggtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagtagcttacctggccttgacatccagagaacatagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 522 - DNA, 1348 bp, Pseudomonas sp.
aacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgtac

SEQ ID NO: 523 - DNA, 1419 bp, Pseudomonas sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagatgcttacctggccttgacatccagagaacatagcagagatgctttggtgccttgcggtactctgagacaggtgctgcatggctgtcgtcagctcgtgttgactaatgttgggttaagtcccgcatgctgcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactta

SEQ ID NO: 524 - DNA, 1424 bp, Pseudomonas sp.
gctacacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaacttgccgattgacgttacccgcagaagaagcaccggctaactccgtgccagcagccgcattaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaatagtagggttaagtcccggtacgagcgcaagccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttgg

SEQ ID NO: 525 - DNA, 1422 bp, Curtobacterium sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgctactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaacattgcagagatggattggtgccttcgggaaccgtgagacaggtgctgcatggctgtcgtcagctcgtgtcctgtcatgttcggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 526 - DNA, 1421 bp, Pseudomonas sp.
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacttctccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgatgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttgat

SEQ ID NO: 527 - DNA, 1420 bp, Erwinia sp.
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagtagcttacctggccttgacatccagagaacttagcagagatgctttggtcgcttcgggaactctgacacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttt

SEQ ID NO: 528 - DNA, 1422 bp, Xanthomonas sp.
tacacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctggccttgacatccagagaacttagcagagatgctttggtcgcttcgggaactctgagacaggtgctgcatggctgtcgtcagctcgtgtagtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacat

SEQ ID NO: 529 - DNA, 1421 bp, Methylobacterium sp.
ctacacatgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttgcagagatgcattggtgccttcgggaactgtgagacaggtgctgcatggctgtcgtcagctcgtgttgtgaaatgttgggttaagtcccgcaacgagcgcaacccttatcctttgttgccagcggtcaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccactt

SEQ ID NO: 530 - DNA, 1424 bp, Luteibacter sp.
tacacatgcagtcgaacggtagcacagagagcttgctctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtggagttaataccttcaccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttga

SEQ ID NO: 531 - DNA, 1428 bp, Agrobacterium sp.
tgctatacatgcagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagtagcttaccaggtcttgacatcctctgacaatcctagagataggacgtccccttcgggggcagagtgacaggtcgtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccg

SEQ ID NO: 532 - DNA, 1403 bp, Pantoea sp.
accatgcaagtcgaacgatgaagcccagcttgctgggtggattagtggcgaacgggtgagtaacacgtgagcaacctgcccctgactctgggataagcgctggaaacggtgtctaatactggatatgtcccatcaccgcatggtgtgtgggtggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgagagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaattccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtgggggagcaaacaggcttagataccctggtagtccaccccgtaaacgttgggaactagttgtggggtcctttccacggattccgtgacgcagctaacgcattaagttccccgcctggggagtacggccgcaaggctaatactcaaaggaattgacggggacccgcacaagcggcggagcatgcggattaattcgatgcaacgcgaagaaccttaccaaggcttgacatacacgagaacgggccagaaatggtcaactctttcgacactcgtgaacagcaggtgcatggttgtcgtcagctcgtgtcgtggacaagttgggttatgtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaagg

SEQ ID NO: 533 - DNA, 1420 bp, Sphingomonas sp.
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggctgtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgatgggataagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactg

SEQ ID NO: 534 - DNA, 1421 bp, Pantoea sp.
acatgcagtcgagcggtagcacaggagagcttgctctccgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcgtcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcacgtgcgaaagcgtggggagcaaacaggattagataccctggtagtccacgccgtatacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagaaccttacctactcttgacatccagagaactttgcagagatgcattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttga

SEQ ID NO: 535 - DNA, 1420 bp, Pantoea sp.
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagtacttagcagagatgctttggtgccttcgggaactctgagacaggtgctgcatggctgtcgtcagctcgtgttgacaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttg

SEQ ID NO: 536 - DNA, 1418 bp, Xanthomonas sp.
catgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacgggccgcaaggttaaaactcaaatgaattgacggggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttcacaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacct

SEQ ID NO: 537 - DNA, 1422 bp, Pantoea sp.
taccatgcagtcgagcggtagcacaggagagcttgctctccgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcgtcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtaccgccgcaaggttaaaactcaaatgaattgacgggggcccgcacaagcggtggagcatgtggtttaattcgatgcaacgcgaagtaccttacctactcttgacatccagagtacttttcagagatgcattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttga

SEQ ID NO: 538 - DNA, 1375 bp, Pantoea sp.
acgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtagacgttgggaaactagttgtggggaccattccacggtttccgtgacgcagctaacgcattaagttccccgcctgggggagtacggccgcaaggctaaaactcaaaaggcaattgacggggacccgcacaagcggcggagcatgcggattaattcgatgcaacgcgaagaaccttaccaaggcttgacatacaccagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtgga

SEQ ID NO: 539 - DNA, 1419 bp, Pantoea sp.
cacatgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctggtcttgacatccacagaacttggcagagatgccttggtgccttcgggaactgtgagaacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccacat

SEQ ID NO: 540 - DNA, 1415 bp, Enterobacter sp.
catgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagtacttggcagacatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccata

SEQ ID NO: 541 - DNA, 1419 bp, Enterobacter sp.
tgacagtcgacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagaaacgttacctggtcttgacatccacagaactttggcagagatgccttggtgccttccggaactgtgacacacgtgctgcatggctgtcgtcagcctcgagttgagaaatggttagggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccatc

SEQ ID NO: 542 - DNA, 1420 bp, Bacillus sp.
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagacaacttagcacagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttg

SEQ ID NO: 543 - DNA, 1410 bp, Bacillus sp.
gacagtcgaacggcagcacagaagaagcttgctctattgggtggcgagtggcggacggtggagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcataaagaagtagttagcttaaccttcgggagggctc

SEQ ID NO: 544 - DNA, 1409 bp, Pantoea sp.
acagcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggccccgcacaagccgtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcta

SEQ ID NO: 545 - DNA, 1417 bp, Enterobacter sp.
cagtcgagcgacagacgaggagcttgctcctctgacgttagcggcggacgggttagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattcccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccgtgtggagtaacctttggagctagcctac

SEQ ID NO: 546 - DNA, 1416 bp, Pantoea sp.
acatgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggcttacagcgaatacctgtgagttttgacgttaccgacagaataagcaccggctaacttcgtgccagcagccgcggtaatacgaagggtgcaagcgttaatcggaattactgggcgtaaagcgcgcgtaggtggcttgataagttggatgtgaaatcccccgggctcaacctgggaactgcatccaaaactgtctggctagagtgtggtagagggtagtggaatttcccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggtttagtcccgtaacgagcgcaacccttgtccttagttaccagcacattatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgga

SEQ ID NO: 547 - DNA, 1367 bp, Pantoea sp.
acatgcagtcgaacgaaggcttcggccttagtggcgcacgggtgcgtaacgcgtgggaatctgcccttaggttcggaataacagctggaaacggctgctaataccggatgatatcgcgagatcaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgcaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgccctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggattttcttcccttcggggactgggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggt

SEQ ID NO: 548 - DNA, 1390 bp, Enterobacter sp.
cagcagtcgaacggtggagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccta

SEQ ID NO: 549 - DNA, 1423 bp, Microbacterium sp.
cacatgcaagtcgaacggcagcacagaggagcttgctccttgggtggcgagtggcggacgggtgaggaatacatcggaatctactttttcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctaccctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaagcttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 550 - DNA, 1333 bp, Enterobacter sp.
gagagccttcggagtttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgctttgggtggcgcagctaacgcacttaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgctgacgcagatc

SEQ ID NO: 551 - DNA, 1405 bp, Enterobacter sp.
tgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggcttacagcgaatacctgtgagttttgacgttaccgacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtgggtttaattcgaagcaacgcgaagaagcttacctgggcttgacatgctgagaactttccagagatggattggtgccttcgggaactcagacacctggtgctgcatggctgtcgtcagctcgtgtcgtgagatgttgggttaagtcccgtaacgagcgcaacccttgtccttagttaccagcacattatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggta

SEQ ID NO: 552 - DNA, 1412 bp, Enterobacter sp.
catgcagtcgagcggatgagaggagcttgctcctcgattcagcggcggacgggtgagtaatgcctaggaatctgcccagtagtgggggacaacgtttcgaaaggaacgctaataccgcatacgtcctacgggagaaagtgggggatcttcggacctcacgctattggatgagcctaggtcggattagctagttggtggggtaacggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggcttacagcgaaatacctgtgagttttgacgttaccaacagaataaagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggattaattcgaagcaacgcgaagaaaccttacctggccatgacttgctgagaactttccagaacatggattggtgccttcgggtactcagacacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcggggggacggtacca

SEQ ID NO: 553 - DNA, 1388 bp, Pantoea sp.
gtagcagtcgtgcgggtgtaagacgcgatgattgctcctcgattcagcggcggacgggtgagtaatggctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggcttacagcgaatacctgtgagttttgacgttaccgacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtgggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagtag

SEQ ID NO: 554 - DNA, 1422 bp, Pantoea sp.
atgcagtcgagcggacttaaaaagcttgctttttaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaacccagaaagccacgggctaactacgtgccagcagccgcggtaatacgtaggtggcaagcgttgtccggaattattgggcgtaaagcgcgcgcaggcggtcctttaagtctgatgtgaaagcccacggctcaacccgtggagggtcattggaaactgggggacttgagtgcagaagagaagagtggaatttccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgtgggtaacccttctgggagccagcct

SEQ ID NO: 555 - DNA, 1422 bp, Pantoea sp.
catgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctccg

SEQ ID NO: 556 - DNA, 1432 bp, Staphylococcus sp.
atacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgaccggtacctaaccagaaaaggccacggctaactacgtgccagcagccgcggtaatacgtaggtggcaagcgttgtccggaattattgggcgtaaagggctcgcaggcggtttcttaagtctgatgtgaaagcccccggctcaacccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggattaattcgaagcaacgcgaagaagcttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggt

SEQ ID NO: 557 - DNA, 1416 bp, Pseudomonas sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctggccttgacatccagagaacttagcagagatgctttggtgccttcgggaacttctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttac

SEQ ID NO: 558 - DNA, 1409 bp, Sphingomonas sp.
cgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccact

SEQ ID NO: 559 - DNA, 1409 bp, Microbacterium sp.
agtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatc

SEQ ID NO: 560 - DNA, 1419 bp, Stenotrophomonas sp.
ctaccatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggcttgacttccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacga

SEQ ID NO: 561 - DNA, 1416 bp, Sphingomonas sp.
acacatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggcgagtacggccgcaaggttaaaactcaaatgaattgacgggggccccgcacaagcggtggagcatgtggtttaattcgatgcaacgcgaagaaccttacctgggccttgacatccagactagatagcagacatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctt

SEQ ID NO: 562 - DNA, 1414 bp, Pseudomonas sp.
atgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggaggagcatgtggtttaattcgatgcaacgcgaagaaccttacctgggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagtgtagcttaaccttcgggagggcgctaccag

SEQ ID NO: 563 - DNA, 1417 bp, Pseudomonas sp.
catgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacgggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttc

SEQ ID NO: 564 - DNA, 1384 bp, Pseudomonas sp.
agccgagcggtatttcttcttcggaagagagagagcggcgtacgggtgcggaacacgtgtgcaacctacctttatcagggggatagcctttcgaaaggaagattaataccccataatatattgaatggcatcatttaatattgaaaactccggtggatagagatgggcacgcgcaagattagatagttggtgaggtaacggctcaccaagtcaatgatctttagggggcctgagagggtgatcccccacactggtactgagacacggaccagactcctacgggaggcagcagtgaggaatattggacaatgggtgaaagcctgatccagccatcccgcgtgaaggacgacggccctatgggttgtaaacttcttttgtacagggataaacctttccacgtgtggaaagctgaaggtactgtacgaataagcaccggctaactccgtgccagcagccgcggtaatacggagggtgcaagcgttatccggatttattgggtttaaagggtccgtaggcggacctgtaagtcagtggtgaaatctcatagcttaactatgaaactgccattgatactgcaggtcttgagtaaatttgaagtggctggaataagtagtgtagcggtgaaatgcatagatattacttagaacaccaattgcgaaggcaggtcactaagatttaactgacgctgagggacgaaagcgtggggagcgaacaggattagataccctggtagtccacgccgtaaacgatgctaactcgtttttggattttcggattcagagaccaagcgaaagtgataagttagccacctggggagtacgtccgcaaggatgaaactcaaaggaattgacgggggcccgcacaagcggtggattatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctaacattcagttgaggactctagtgagactgcctacgcaagtagagaggaaggtggggatgacgtcaaatcatcacggcccttacgtcttgggccacacacgtaatacaatggccggtacagagggcagctacacagcgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtttggggtacctgaagtcggtgaccgtaaaaggagctgccta

SEQ ID NO: 565 - DNA, 1414 bp, Bacillus sp.
ctaccatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctca

SEQ ID NO: 566 - DNA, 1403 bp, Bacillus sp.
cagtcgacggcagcacagaatgagcttgctctttgggtggcgagtggcggacgggtgagtaatagtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagttagcttaacctcgggagggct

SEQ ID NO: 567 - DNA, 1417 bp, Bacillus sp.
cacatgcagtcgagcggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccac

SEQ ID NO: 568 - DNA, 1417 bp, Pantoea sp.
catgcagtcgacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaatttccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtgggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 569 - DNA, 1413 bp, Pantoea sp.
tcgacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaaggtactttcagccgggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagaagaacttagcacagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 570 - DNA, 1432 bp, Pantoea sp.
tatacatgcagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaatgtgtaagtaactgtgcacatcttgacggtacctgatcagaaagccacggctaactacgtgccagcagccgcggtaatacgtaggtggcaagcgttatccggaattattggggcgtaaagcgcgcgtaggcggtttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcggaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcga

SEQ ID NO: 571 - DNA, 1391 bp, Pantoea sp.
agcagtcgacggtgaaagagagcttgctctctggatcagtggcgaacgggtgagtaacacgtgagcaatctgcccctgactctgggataagcgctggaaacggcgtctaataccggatacgagctgcgaaggcatcttcagcagctggaaagaacttcggtcagggatgagctcgcggcctatcagctagttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgcaaaggcagatctctgggccgtaactgacgctgaggagcgaaagggtggggagcaaatcaggctttagataccctggtagtccaccccgtaaacgttgggaactagttgtggcgtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccatggcttgacatatacgagaacgctgcagaaatgtagaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagcct

SEQ ID NO: 572 - DNA, 1379 bp, Pantoea sp.
tgcaagtcgaacgatgaagcccagcttgctgggtggattagtggcgaacgggtgagtaacacgtgagtaacctgcccttaactctgggataagcctgggaaactgggtctaataccggataggagcgcccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacggggggcccgcacaagcggcggagcatgcggattaatttgatgcaacgcgaagaaccttaccaaggcttgacatgttcctcgatcgctgtacagatacggtttcccctttgggacgggttcacaggtggtgcatggttgtagtcagctcgtgtcgtgagatgtagggttaagtcccgcaacgagcgcaaccctcgttccatgttgccagcacgtcgtggtggggaatcatgggaggctgccggggtcaactaggaggaaggtgaggacgacgtcaaatcatcatgccccttatgtcttgggcttcacgcatgctacaatggccggtacaatgggttgcgatactgtgaggtggagctaatcccaaaaagccggtctcagttcggatgggggtgtgcaactcgaccccatgaagtcggagtcgctagtaatcgcagatcagcaacgatgcggtgaatacgttcccgggccttgtacaccccgcccgtcaagtcacgaaagttggtaacacccgaagccggtggcctaaccctt

SEQ ID NO: 573 - DNA, 1398 bp, Pantoea sp.
accatgcagtcgaacgatgaagcccagcttgctgggtggattagtggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattccctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagtagcttaccaaggcttgacatgttctcgatcgccgtagagatacggttttccctttggggcgggatcacaggatggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcg

SEQ ID NO: 574 - DNA, 1396 bp, Pantoea sp.
ttgcagtcgaacgatgaagcccagcttgctgggtggattagtggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaacccccggatctgcggtgggtacgggcagactagagtgcagtaggggagactggaattccctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacgggtttcccgtttggggcgggttcacaggacgatgtacgatgtcgtcagctcgtgtcgtgagatgttgggataagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttctggtaacacccgaagccggtggcctaacccttgtggggggagccgt

SEQ ID NO: 575 - DNA, 1407 bp, Chryseobacterium sp.
agcagtcgagcggacagatgggtagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtcgtgcatggttgtcgtcagctcgtgtcgtgagatgttgggttaagtcccgcaacgagcgcatcccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttag

SEQ ID NO: 576 - DNA, 1412 bp, Pantoea sp.
cagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagcccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtgggagatcaaacaggattagataccctggtagtccacgccgtaaacgatgagtgctaagtgttagggggtttccgccccttagtgctgcagctaacgcattaagcactccgcctggggagtacgaccgcatggttgaaactcaaaggaattgacggggacccgcacaagcggtggagcatgtggtttaattcgaagcaacgcgaagtaccttaccaaatcttgacatcctctgacccctctagagatagagttttccccttcgggggacagagtgacaggtggtgcatggttgtcgtcagctcgtgtcgtgagatgatgggttatcacccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccgttggagtaaccatttggagct

SEQ ID NO: 577 - DNA, 1404 bp, Pantoea sp.
cacatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaaggcttgacatacaccggaaacggccagagatggttgcccccgttgtggtcggtgtacaggtggagcatggggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaatg

SEQ ID NO: 578 - DNA, 1366 bp, Pantoea sp.
catgcaagtcgaacgaaggcttcggccttagtggcgcacgggtgcgtaacgcgtgggaatctgcccttaggttcggaataacagctggaaacggctgctaataccggatgatgacgaaagtccaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagcccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaaacacaggtgctgcatggctgtcgtcagctcgtgtcgtgagatgttggggttaagtccccgaacgagcgcaaccctcgcctttagttaccatcattgagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgg

SEQ ID NO: 579 - DNA, 1366 bp, Pantoea sp.
accatgcagtcgaacgaaggcttcggccttagtggcgcacgggtgcgtaacgcgtgggaatctgcccttaggttcggaataacagctggaaacggctgctaataccggatgatgacgaaagtccaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggtctaactccgtgccagcagccgcggtaatacggagggggctagcgttgttcggaattactgggcgtaaagcgcacgtaggcggctttgtaagtcagaggtgaaagccctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggttaagtcccgcaacgagcgcaaccctcgcctttagttaccatcattgagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgg

SEQ ID NO: 580 - DNA, 1397 bp, Pantoea sp.
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 581 - DNA, 1415 bp, Staphylococcus sp.
tagtcggacggtagcacagaggagcttgctcctcgggtgacgagtggcggacgggtgagtagtgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacagtgggcgcaagcctgatgcacccatgccgcgtgtatgaagaaggccttcgggttgtaaagtactttcagcggggaggaaggcgatgaggttaataaccttgttgattgacgttacccgcagaagaagcacccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcacgtgcgaaagcgtggggagcaaacacgattagataccctggtagtccacgccgtaaacgatgtcgacttggaggttgttcccttgacgagtggcttccggagctaacgcgttaagtcgaccgcctggggagtacggccgcaaggttaaaactcaaatgaattgacgggggcccgcacaagcggtggagcatgtggttttatttcgatgctacgcgaacaaccttaccctactcttgacatccacggaattcggcagagatgccttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccacta

SEQ ID NO: 582 - DNA, 1426 bp, Microbacterium sp.
accatgcagtcggacggtagcacagaggagcttgctcctcgggtgacgagtggcggacgggtgagtagtgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagacggcctttcgcgggttgtaaagtactttccaagcggggaggaaggcgatgaggttaataaccttgttgattgacgttacccgcaggaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcacgtgcgaaagcgtggggagcaaacacgattacataccctggtagtccacgccgtaaacgatgtcgacttggaggttgttcccttgaggagtggcttcccgagctaacgcgttaagtcgaccgcctggcgagtacggccgcaaggttaaaactcaaatgaattgacgggggcccgcacaagcggtggagcatgtggtttaattccatgcatcgcgaagaaccttacctactcttgacatccaccgaacttagggcagagatgccttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccact

SEQ ID NO: 583 - DNA, 1395 bp, Micrococcus sp.
ccatgcagtcgacgatgatgcccagcttgctgggtggattagtggcgaacgggtgagtaacacgtgagtaacctgcccctgactctgggataagcgttggaaacgacgtctaatactggatatgaccgccgatcgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggcagagatggtcgcccccttggtggtcggtgtacaggtggtgcatgggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcg

SEQ ID NO: 584 - DNA, 1422 bp, Micrococcus sp.
cacatgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaaccctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatgggatttggtgccttcgggaactgtgagacaggtgctgcatggctgtcgtcagctcgtgttgtgaaatgttgggataagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaaactcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactt

SEQ ID NO: 585 - DNA, 1420 bp, Micrococcus sp.
accatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggcccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactt

SEQ ID NO: 586 - DNA, 1402 bp, Bacillus sp.
catgcaagtcgaacgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacaccgtagaaatacgggactctttggacactgggtgaacaggtggtgcatggttgtcgtcagctcgtggtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtg

SEQ ID NO: 587 - DNA, 1399 bp, Staphylococcus sp.
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacagccagagatggttgcccccttgtggtcggtgtacacgtggtgcatgggttgtcgtcagctcgtgtcgtgacttgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaatgg

SEQ ID NO: 588 - DNA, 1422 bp, Curtobacterium sp.
acatgcaagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 589 - DNA, 1410 bp, Sphingomonas sp.
accatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaaaccctcttttagtagggaagaagcgtaagtgacggtacctgcagaaaaaagcaccgggctaactacgtgccagcagccgcggtaatacgtagggtgcaagcgttgtccgggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacagccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgattc

SEQ ID NO: 590 - DNA, 1393 bp, Sphingomonas sp.
caagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgccaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 591 - DNA, 1418 bp, Curtobacterium sp.
ccatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccac

SEQ ID NO: 592 - DNA, 1425 bp, Pantoea sp.
accatgcaagtcgaacggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccatctggctaatacccgggtgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagcccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 593 - DNA, 1423 bp, Pantoea sp.
ccatgcagtcgaacggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccatctggctaatacccgggtgggatgacggtacccaaagaataagcaccggctaacttcgtgccagcagccgcggtaatacgaagggtgcaagcgttactcgggaattactgggcgtaaagcgtgcgtaggtggtcgtttaagtccgttgtgaaagccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgga

SEQ ID NO: 594 - DNA, 1436 bp, Curtobacterium sp.
atacatgcagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagcccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaaggtcttgacatccctctgaccggtacagagatgtaccttttccttcgggacagaggagacaggtggtgcatgggttgtcgtcagctcgtgtcctgaagcatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaa

SEQ ID NO: 595 - DNA, 1430 bp, Enterobacter sp.
tacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtcccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcggggcacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaatg

SEQ ID NO: 596 - DNA, 1442 bp, Pantoea sp.
ctatacatgcaagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaaggtgacggtacctgagaagaaagccccggctaactacgtgcccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagagcagacaggtggtgcatggttgtcgtcagctcgtgtcgtgagatgttgggttaagtcccgcaaggagccgcgatcccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgg

SEQ ID NO: 597 - DNA, 1432 bp, Microbacterium sp.
acatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaacccagaaagccaacggctaactacgtgccagcagccgcggtaatacgtaggtggcaagcgttgtccggaattattgggcgtaaagcgcgcgcaggtggttcccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaagt

SEQ ID NO: 598 - DNA, 1428 bp, Curtobacterium sp.
acatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaacccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaaggtcttgacatcctctgacaatcctagagataggacgtccccttcgggggcagagtgacaggaggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 599 - DNA, 1441 bp, Xanthomonas sp.
ctatacatgcaagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgagcgggtacagagatgtaacgtttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgtt

SEQ ID NO: 600 - DNA, 1433 bp, Curtobacterium sp.
atactgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgcccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggcgagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttcccctttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaagtgac

SEQ ID NO: 601 - DNA, 1426 bp, Curtobacterium sp.
gcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaaagccacggctaactacgtgccagcagccgcggtaatacgtaggtggcaagcgttgtccggaattattgggcgtaaagcgcgcgcaggtggttcctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccagggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 602 - DNA, 1429 bp, Xanthomonas sp.
tacatgcaagtcgagcgaatcagatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggcgtcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 603 - DNA, 1426 bp, Stenotrophomonas sp.
taatgcaagtcgagcggactttaaaagcttgcttttaaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaatctgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattaagttgggcactttaaggtgactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaagg

SEQ ID NO: 604 - DNA, 1429 bp, Stenotrophomonas sp.
ataatgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttcctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtgggagcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 605 - DNA, 1436 bp, Paenibacillus sp.
aatacatgcagtcgagcggacttgcatgagaagcttgcttctctgatggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgcccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtgggtttaattcgaagcaacgcgaagaacccttaccaggtcttgacatccctctgaacgggtacagagatgtaacttttccttcgggacagaggacacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatg

SEQ ID NO: 606 - DNA, 1428 bp, Bacillus sp.
ctatacatgcagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccgggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataaggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccg

SEQ ID NO: 607 - DNA, 1408 bp, Paenibacillus sp.
accatgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttgggacactcgtaaacaggtgggtgcatgggtagtcgtcagctcgtgtcgtgagatgttggggttaagtcccgcaacgagcgcaaccctcgttctatgttgccagcacgtaatggaggggaactcatggggaaactgccggggtgaactcggcaggaacgaggggtagacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtg

SEQ ID NO: 608 - DNA, 1429 bp, Bacillus sp.
tacatgcagtcgagcggacttgcatgagaagcttgcttctctgataggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtatctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaa

SEQ ID NO: 609 - DNA, 1378 bp, Bacillus sp.
cagtctatacatgcaagtcgaacgagatcttcggatctagtggcgcacgggtgcgtaacgcgtgggaatctgcccttgggttcggaataacttctggaaacggaagctaataccggatgatgacgtaagtccaaagatttatcgcccaaggatgagcccgcgtaggattagctagttggtggggtaaaggcccaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtgggagacactttccttcagttcggctggataggtgacaggtgctgcatggctgtcgtcagctcgtgtcgtgagatgttggggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacagtgta

SEQ ID NO: 610 - DNA, 1440 bp, Paenibacillus sp.
ctatactgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccaccggctaactacgtgcccagcagccgcggtaatacgtaggtttggcaagcgattagaccggaattattggggccgtaaacccccccggctggaggttcccttactctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaagg

SEQ ID NO: 611 - DNA, 1399 bp, Bacillus sp.
taccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaag

SEQ ID NO: 612 - DNA, 1360 bp, Bacillus sp.
ccatgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtactcggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccactg

SEQ ID NO: 613 - DNA, 1363 bp, Bacillus sp.
atgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttaggggttgtaaagctcttttattccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcatttagttggggcactcttcggagactggcggtgattagccgcgaggaaggagtgggatgacgtcaaggtcctcatgggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccactg

SEQ ID NO: 614 - DNA, 1362 bp, Bacillus sp.
taccatgcagtcgagcggacctttcggggtcagcggcggacgggtgagtaacgcgtgggaacgtgccttctggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacgat

SEQ ID NO: 615 - DNA, 1399 bp, Bacillus sp.
atgcagtcgaacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggcctttccgggttgtaaacctcttttagtagggaagaaagcgaaagtgacggtaccttgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 616 - DNA, 1399 bp, Paenibacillus sp.
ccatgcagtcgacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaaggcttgacatatacgagaacgggccagaaatgggacaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaatg

SEQ ID NO: 617 - DNA, 1429 bp, Bacillus sp.
tatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtcccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaa

SEQ ID NO: 618 - DNA, 1429 bp, Microbacterium sp.
atacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtgggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 619 - DNA, 1426 bp, Paenibacillus sp.
taccatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgcccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtgggtttaattcgatgcaacgcgaagaacccttacctgggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 620 - DNA, 1394 bp, Sphingobium sp.
gcatgcagtcgacgatgaagcccagcttgctgggtggattagtggcgaacgggtgagtaacacgtgagtaacctgcccttaactctgggataagcctgggaaactgggtctaataccggatatgagcgcctaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagtagcttaccaaggcttgacatgtactcgatcggcgtagagatacggtttcccgttaggggcgggttctgtggtggtgcatggttgtcgtcagctcgtgtcgtgagatgttgggttaagtcccgcaacgagcgcaaccctcgttccatgttgccagcacgtcgtggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtac

SEQ ID NO: 621 - DNA, 1421 bp, Bacillus sp.
atgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaatttccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaacgatcccgttctaccttaccaggtgatgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcc

SEQ ID NO: 622 - DNA, 1419 bp, Curtobacterium sp.
ccatgcagtcggacggtagcacagaggagcttgctcctcgggtgacgagtggcggacgggtgagtaatgtctggggatctgcccgatagagggggataaccactggaaacggtggctaataccgcaaaacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaatttccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggattaaactcaaatgaattgacgggggcccgcacaagcggtggagcatgtggtttaattcgatgcaacgcgaagaaccatacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggctagcttaaccttcgggagggcgctaccactt

SEQ ID NO: 623 - DNA, 1436 bp, Methylobacterium sp.
atacatgcagtcgagcggacttgcatgagaagcttgcttctctgatggttagcggcggacgggtgagtaacacgtaggcacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaagcgcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggttttattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgatc

SEQ ID NO: 624 - DNA, 1355 bp, Methylobacterium sp.
atagcagtcgacgccccgcaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctgggcccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctatcca

SEQ ID NO: 625 - DNA, 1422 bp, Methylobacterium sp.
acacatgcagtcgagcggtagagaggtgcttgcacctcttgagagcggcggacgggtgagtaaagcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgttgtagcggtgaaatgcgtgatacagatataggaaggaacaccagtggcgaaggcgacccacctggactgatactgacactgaggtgcgaaagcgtggggagcaaacaggattagataccctgggtagtccacgcccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagtaccttaccaggccttgacatcctatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggtaccacg

SEQ ID NO: 626 - DNA, 1400 bp, Curtobacterium sp.
cctgcagtcgaacggcagcacgggggcaccctggtggcgagtggcgaacgggtgagtaatacatcggaacgtgtcctgtagtgggggatagcccggcgaaagccggattaataccgcatacgatctgtggatgaaagcgggggatcttaggacctcgcgctacaggggcggccgatggcagattagctagttggtggggtaaaggcctaccaaggcgacaatatgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctcttggttaatacctgagggggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaatttccacgtgtagcagtgaaatgcgtagagatgtggaggaataccgatggcgaaggctgccccctgggccaatactgacgctcatgcacgaaagcgtggggagcaaacaggattagataccctggtagtccacgccctaaacgatgtcaactagttgtcgggtcttcattgacttggtaacgtagcttacgcgtgaagttgaccgcctggggagtacggtcgcaagaataaaactcaaaggaattgacggggacccgcacaagcggtggatgatgtggattaattcgatgcaacgcgaaaaaccatacctacccatgacatgtatggaatcctgctgacacgagggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtct

SEQ ID NO: 627 - DNA, 1401 bp, Microbacterium sp.
ccatgcagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggt

SEQ ID NO: 628 - DNA, 1419 bp, Bacillus sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctgggccttgacatccagagaacttagcagagatgctttggtgccttcggggactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccattt

SEQ ID NO: 629 - DNA, 1396 bp, Bacillus sp.
gaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaaccctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttgggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcac

SEQ ID NO: 630 - DNA, 1417 bp, Xanthomonas sp.
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgctacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccac

SEQ ID NO: 631 - DNA, 1419 bp, Micrococcus sp.
acatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgcccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggcgagtacggccgcaaggttaaaactcaaatgaattgacgggggcccgcacaagcggtggagcatgtggtttaattcgatgcaacgcgaagaaccttacctgggccttgacatccagagaacttagcagagatgctttggacgcttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatag

SEQ ID NO: 632 - DNA, 1393 bp, Bacillus simplex
acttgaagagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggcagcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaac

SEQ ID NO: 633 - DNA, 1401 bp, Pantoea ananatis
gaagcttgcttccttgatacttagcaggcggacgggtgagtaacacgtaggcaacctgccctcaagcttgggacaactaccggaaacggtagctaataccgaatacttgttttcttcgcctgaagggaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagcctc

SEQ ID NO: 634 - DNA, 1429 bp, Paenibacillus taichungensis
tacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtgggagcatgtgggtttaattcgaagcaacgcgaagaaccttaccaggtcttgacatcctctgacatccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatgg

SEQ ID NO: 635 - DNA, 1418 bp, Agrobacterium tumefaciens
cacatgcagtcgaacggtagcacagaggagcttgctcctcgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctggttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgatacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattaggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccatag

SEQ ID NO: 636 - DNA, 1388 bp, Pseudomonas sp.
gcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagctt

SEQ ID NO: 637 - DNA, 1394 bp, Burkholderia phytofirmans
atgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 638 - DNA, 1409 bp, Burkholderia sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtcatgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggc

SEQ ID NO: 639 - DNA, 1419 bp, Erwinia sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctactcata

SEQ ID NO: 640 - DNA, 1410 bp, Burkholderia sp.
tcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggccttgacatccagagaacttagcagagatgctttgggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccata

SEQ ID NO: 641 - DNA, 1392 bp, Erwinia sp.
acttgcagtcgaacggtgaagccaagcttgcttggtggatcagtggcgaacgggtgagtaacacgtgagcaacctgccctggactctgggataagcgctggaaacggcgtctaatactggatatgagccttcatcgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccta

SEQ ID NO: 642 - DNA, 1398 bp, Erwinia sp.
gcacatgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaaagcgccggctaactacgtgccagcagccgcggtaatacgtagggcgcaagcgttatccgggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacgggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtc

SEQ ID NO: 643 - DNA, 1391 bp, Paenibacillus sp.
acatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccgggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 644 - DNA, 1420 bp, Paenibacillus sp.
acatgcagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaacctttacctactcttgacatccagcgaacggggcagagatgccgccgagtgtgcttcgggtacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccata

SEQ ID NO: 645 - DNA, 1386 bp, Bacillus sp.
agcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctg

SEQ ID NO: 646 - DNA, 1386 bp, Enterobacteriaceae; identical to SEQ ID NO: 645

SEQ ID NO: 647 - DNA, 1362 bp, Erwinia sp.
cacatgcagtcgaacgagatcttcgggtctagtggcgcacgggtgcgtaacgcgtgggaatctgccctttggttcggaataacagttggaaacgactgctaataccggatgatgacgaaagtccaaagatttatcgccagaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccat

SEQ ID NO: 648 - DNA, 1400 bp, Microbacterium sp.
aagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 649 - DNA, 1391 bp, Erwinia sp.
acatgcagtcgaacggtgaagccaagcttgcttggtggatcagtggcgaacgggtgagtaacacgtgagcaacctgccctggactctgggataagcgctggaaacggcgtctaatactggatatgagcctcttccgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccg

SEQ ID NO: 650 - DNA, 1396 bp, Erwinia sp.
gcaagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtaccctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaa

SEQ ID NO: 651 - DNA, 1419 bp, Erwinia sp.
atgcagtcgagcgaatggattaagagcttgctcttatgaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaagcttaccatggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccg

SEQ ID NO: 652 - DNA, 1361 bp, Microbacterium sp.
catgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgtag

SEQ ID NO: 653 - DNA, 1350 bp, Microbacterium sp.
gtaggcaacctgccctcaagcttgggacaactaccggaaacggtagctaataccgaatacttgttttcttcgcctgaagggaactggaaagacggagcaatctgtcacttgaggatgggcctgcggcgcattagctagttggggaggtaacggctcaccaaggcgacgatgcgtagccgacctgagagggtgatcggccacactgggactgaaacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagcca

SEQ ID NO: 654 - DNA, 1360 bp, Curtobacterium sp.
catagcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaacccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagaatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccac

SEQ ID NO: 655 - DNA, 1408 bp, Erwinia sp.
cacatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 656 - DNA, 1365 bp, Burkholderia sp.
acatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagaatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactataat

SEQ ID NO: 657 - DNA, 1418 bp, Burkholderia sp.
agcagtcgagcggagttgatgggaaagcttgcttccctgagacttagcggcggacgggtgagtaacacgtaggcaacctgccctcaagcttgggacaactaccggaaacggtagctaataccgaatacttgttttcttcgcctgaagggaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccagggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaactgcaaggagcc

SEQ ID NO: 658 - DNA, 1402 bp, Sphingomonas sp.
catgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 659 - DNA, 1362 bp, Burkholderia sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacggcggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgta

SEQ ID NO: 660 - DNA, 1426 bp, Microbacterium sp.
tacatgcaagtcgagcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatg

SEQ ID NO: 661 - DNA, 1412 bp, Microbacterium sp.
gcaagagaagcttgcttctctgatgcgttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccgggaattattgggcgtaaagcgcgcgcaggcggtcatgtaagtctggtgtttaatcccggggctcaaccccggatcgcactggaaactgtgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacgcgcacaagcagtggagtatgtggtttaattcgaagcaacgcgaagaaccttaccagggtcttgacatccaactaacgaggcagagatgcatcaggtgcccttcggggaaagttgagacaggtggtgcatggttgtcgtcagctcgtgtcgtgagatgttgggttaagtcccgcaacgagcgcaacccttatatttagttgccagcatttcggatgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagcctccg

SEQ ID NO: 662 - DNA, 1393 bp, Bacillus sp.
cttgaagagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgtgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgcagtatgtggtttaattcgaagcaacgcgaagaaccttaccaggtcttgacatccaactaacgaggcagagatgcatcaggtgcccttcggggaaagttgagacaggtggtgcatggttgtcgtcagctcgtgtcgtgagatgttgggttaagtcccgcaacgagcgcaacccttatatttagttgccagcacttcggatgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaact

SEQ ID NO: 663 - DNA, 1399 bp, Ochrobactrum sp.
acacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacagggtggtgcatgggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtc

SEQ ID NO: 664 - DNA, 1355 bp, Paenibacillus sp.
catagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcc

SEQ ID NO: 665 - DNA, 1411 bp, Ochrobactrum sp.
tacacatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagatccggaacacaggtgctgcatggctgtcgtcagctcgtgtcgtgagatgttgggataagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactagt

SEQ ID NO: 666 - DNA, 1429 bp, Achromobacter sp.
actacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccagggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatg

SEQ ID NO: 667 - DNA, 1424 bp, Ochrobactrum sp.
tacatgcagtcgagcggacttaaaaagcttgctttttaagttagcggcggacgggtgagtaacacgtgggcaacctgcctgtaagactgggataacttcgggaaaccggagctaataccggataatcctttcctactcatgtaggaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccgggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcct

SEQ ID NO: 668 - DNA, 1418 bp, Paenibacillus sp.
catgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaacgctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgc

SEQ ID NO: 669 - DNA, 1369 bp, Achromobacter sp.
agacagtcgagcggtaaggcctttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaacc

SEQ ID NO: 670 - DNA, 1405 bp, Ochrobactrum sp.
ccatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcggatgagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 671 - DNA, 1388 bp, Bacillus sp.
gaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctgcaaggagga

SEQ ID NO: 672 - DNA, 1394 bp, Paenibacillus sp.
gaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 673 - DNA, 1390 bp, Paenibacillus sp.
agcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctgcaag

SEQ ID NO: 674 - DNA, 1401 bp, Microbacterium sp.
cagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctaccccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 675 - DNA, 1403 bp, Ochrobactrum sp.
atgcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 676 - DNA, 1405 bp, Achromobacter sp.
catgcagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtctacc

SEQ ID NO: 677 - DNA, 1334 bp, Bacillus sp.
catagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggacgggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggtttacccgaaggcgctgtgctaa

SEQ ID NO: 678 - DNA, 1367 bp, Bacillus sp.
catagcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttgggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgaagatgattgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactatagt

SEQ ID NO: 679 - DNA, 1403 bp, Bacillus sp.
atgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcatgagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 680 - DNA, 1356 bp, Rhodococcus sp.
atagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtccac

SEQ ID NO: 681 - DNA, 1419 bp, Achromobacter sp.
ctacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcc

SEQ ID NO: 682 - DNA, 1341 bp, Burkholderia sp.
ttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtc

SEQ ID NO: 683 - DNA, 1391 bp, Burkholderia sp.
cgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaacgcagcctcctgggataacactgacgctcatgcacgatagcgtggggagcaaacaggattagataccctggtagtccacgccctaaacgatgtcaactagctgttggggccttcgggccttgctagcgcagctaacgcgtgaagttgaccgcctggggagtacggtcgcaagattaatactcaaaggaattgacggggacccgcacaagcggtggatgatgtggattaattcgatgcaacgcgaaaaagcttacctacccttgacatgtctggaattccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgata

SEQ ID NO: 684 - DNA, 1364 bp, Burkholderia sp.
cgatgaacctggagcttgctctgggggattagtggcgaacgggtgagtaacacgtgagcaacctgcccctgactctgggataagcgctggaaacggcgtctaatactggatacgaacaagaatcgcatggttacttgttggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacggaccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggcagcgataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaac

SEQ ID NO: 685 - DNA, 1423 bp, Burkholderia sp.
tacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccga

SEQ ID NO: 686 - DNA, 1419 bp, Burkholderia sp.
catgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagtagcttaccaggtcttgacatcctctgacatccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctct

SEQ ID NO: 687 - DNA, 1363 bp, Burkholderia sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaacccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggttacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactata

SEQ ID NO: 688 - DNA, 1353 bp, Ochrobactrum sp.
tgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcca

SEQ ID NO: 689 - DNA, 1352 bp, Ochrobactrum sp.
tagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagcccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaacctgcaaggaggcaggcg

SEQ ID NO: 690 - DNA, 1390 bp, Achromobacter sp.
agtcgacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcg

SEQ ID NO: 691 - DNA, 1407 bp, Ochrobactrum sp.
accatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccatag

SEQ ID NO: 692 - DNA, 1393 bp, Bacillus sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtaccctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaatagctcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccg

SEQ ID NO: 693 - DNA, 1392 bp, Rhodococcus sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaagcttaccaaggcttgacatatacgagaacgggccagaaatggtcaactctttggacactcgtaaacaggacgtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccg

SEQ ID NO: 694 - DNA, 1361 bp, Achromobacter sp.
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactatagt

SEQ ID NO: 695 - DNA, 1403 bp, Microbacterium sp.
catgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcctgaagagatttgggaagtgctcgcaagagaatcgggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatac

SEQ ID NO: 696 - DNA, 1430 bp, Bacillus sp.
agtcgagcggagtcttggttggaagcttgcttccaacttggcttagcggcggacgggtgagtaacacgtaggcaacctgcccctaagactgggataactaccggaaacggtagctaataccggataatctctttcctctcctgagggaagaatgaaaggcggagcaatctgccacttggggatgggcctgcggcgcattagctagttggcggggtaacggcccaccaaggcgacgatgcgtagccgacctgagagggtgaacggccacactgggactgagacacggcccagactcctacgggaggcagcagtagggaatcttccgcaatgggcgacagcctgacggagcaacgccgcgtgagtgatgaaggttttcggatcgtaaagctctgttgccagggaagaacgtccggtagagtaactgttaccggagtgacggtacctgagaagaaagccccggctaactacgtgccagcagccgcggtaatacgtagggggcaagcgttgtccgggaattattgggcgtaaagcgcgcgcaggcggctatttaagtctggtgtttaaaccttgggctcaacctggggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaacctttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggttgagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagcctccg

SEQ ID NO: 697 - DNA, 1404 bp, Bacillus sp.
ccatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcggatctctttaggaagtgctcgcaagagaacccgtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccag

SEQ ID NO: 698 - DNA, 1409 bp, Ochrobactrum sp.
cagtcgagcgatggattgagagcttgctctcaagaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccgggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggag

SEQ ID NO: 699 - DNA, 1359 bp, Ochrobactrum sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccact

SEQ ID NO: 700 - DNA, 1438 bp, Ochrobactrum sp.
actaatacatgcaagtcgagcggacttgatgagaagcttgcttctctgatgcgttagcggcggacgggtgagtaacacgtaggcaacctgccctcaagtttgggacaactaccggaaacggtagctaataccgaatagttgtttccttcgcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctccaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgggagtatgtggtttaattcgaagcaacgcgaagaaccttaccaggtcttgacatccgaatgaccggtgcagagatgtaccttttcttcggaacattcaagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatg

SEQ ID NO: 701 - DNA, 1398 bp, Achromobacter sp.
cacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaagcttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcga

SEQ ID NO: 702 - DNA, 1357 bp, Achromobacter sp.
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacta

SEQ ID NO: 703 - DNA, 1422 bp, Microbacterium sp.
aatacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggatttgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctc

SEQ ID NO: 704 - DNA, 1409 bp, Microbacterium sp.
taccatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 705 - DNA, 1415 bp, Ochrobactrum sp.
gcagtcggacggtagcacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtgggtttaattcgatgcaacgcgaagaaccttacctactcttgacatccagcgaactttccagagatgggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccatag

SEQ ID NO: 706 - DNA, 1398 bp, Achromobacter sp.
caacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccata

SEQ ID NO: 707 - DNA, 1415 bp, Paenibacillus sp.
atgcagtcggacggtagcacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgctgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccatag

SEQ ID NO: 708 - DNA, 1421 bp, Achromobacter sp.
gcaagtcgagcggacttaaaaagcttgctttttaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcctat

SEQ ID NO: 709 - DNA, 1416 bp, Bacillus sp.
cacatgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatat

SEQ ID NO: 710 - DNA, 1403 bp, Ochrobactrum sp.
accatgcagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtca

SEQ ID NO: 711 - DNA, 1401 bp, Paenibacillus sp.
atgcagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 712 - DNA, 1406 bp, Microbacterium sp.
cacatgcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 713 - DNA, 1382 bp, Ochrobactrum sp.
tgtagtcgacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaagg

SEQ ID NO: 714 - DNA, 1407 bp, Bacillus sp.
tcgacggtacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgcccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtgggggagcaaacaggattagataccctggtagtccacgccgtaaacgatgtcgacttggaggttgtgcccttgaggcgtggcttccggagctaacgcgttaagtcgaccgcctggggagtacggccgcaagggttaaaactcaaatgaattgacgggggcccgcacaagcggtggagcatgtggtttaattcgatgcaacgcgaagaaccttacctggtcttgacatccacagaacttggcagagatgcaaaggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctactc

SEQ ID NO: 715 - DNA, 1415 bp, Achromobacter sp.
accatgcagtcgacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatat

SEQ ID NO: 716 - DNA, 1399 bp, Enterobacteriaceae
caagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcac

SEQ ID NO: 717 - DNA, 1412 bp, Enterobacteriaceae
catgcagtcggacggtagcacagagagcttgctctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtacagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacggagcagagatgccccggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccat

SEQ ID NO: 718 - DNA, 1393 bp, Pantoea sp.
atgcaagtcgaacgatgatcaggagcttgctcctgtgattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccgggaaatgggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 719 - DNA, 1373 bp, Bacillus sp.
agaggagcttgctcctcgattcagcggcggacgggcgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaacta

SEQ ID NO: 720 - DNA, 1389 bp, Enterobacter sp.
cagcagtcgacgatgaagcccagcttgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccga

SEQ ID NO: 721 - DNA, 1416 bp, Burkholderia sp.
acatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccat

SEQ ID NO: 722 - DNA, 1405 bp, Burkholderia sp.
cacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacgg

SEQ ID NO: 723 - DNA, 1410 bp, Burkholderia sp.
tgcagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccactag

SEQ ID NO: 724 - DNA, 1403 bp, Curtobacterium sp.
atgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcacagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaaccctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacgg

SEQ ID NO: 725 - DNA, 1415 bp, Enterobacter sp.
catgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacccat

SEQ ID NO: 726 - DNA, 1413 bp, Enterobacter sp.
acacatgcagtcgagcggatgatgggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagcttgttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggtaccacg

SEQ ID NO: 727 - DNA, 1417 bp, Burkholderia sp.
atgcaagtcgagcggatgaggggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctgggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacggagtat

SEQ ID NO: 728 - DNA, 1337 bp, Erwinia sp.
attgctgggtggattagtggcgaacgggcgaaaaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagcc

SEQ ID NO: 729 - DNA, 1390 bp, Curtobacterium sp.
acatgcaagtcgaacgatgatgcccagcttgctgggtggattagtggcgaacgggtgagtaacacgtgagtaacctgcccctgactctgggataagcgttggaaacgacgtctaatactggatatgactactggtcgcatggcctggtggtggaaagattctttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 730 - DNA, 1397 bp, Pseudomonas sp.
taccatgcagtcgaacgatgatcaggagcttgctcttgtgattagtggcgaacgggtgagtaacacgtgagtaacctgcccctgactctgggataagcgttggaaacgacgtctaatactggataggactactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgcccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtcgtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcg

SEQ ID NO: 731 - DNA, 1398 bp, Curtobacterium sp.
tacacatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccgggaaacggccagagatggatcgccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtc

SEQ ID NO: 732 - DNA, 1401 bp, Enterobacteriaceae
ttaccatgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtgggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaat

SEQ ID NO: 733 - DNA, 1393 bp, Pseudomonas sp.
cacatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 734 - DNA, 1428 bp, Pseudomonas sp.
tatacatgcagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 735 - DNA, 1426 bp, Pseudomonas sp.
catgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaatg

SEQ ID NO: 736 - DNA, 1392 bp, Enterobacteriaceae
tcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaacctcgggagga

SEQ ID NO: 737 - DNA, 1390 bp, Pseudomonas sp.
catgcagtcgacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 738 - DNA, 1396 bp, Pseudomonas sp.
cacatgcagtcggacggtagcacagagagagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtgggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagctta

SEQ ID NO: 739 - DNA, 1365 bp, Curtobacterium sp.
cacatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggcccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccactgta

SEQ ID NO: 740 - DNA, 1413 bp, Curtobacterium sp.
tgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaaccctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttgccagagatgcgttggtgccttcgggtactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccac

SEQ ID NO: 741 - DNA, 1369 bp, Curtobacterium sp.
tcgacgatgatgcccagcttgctgggtggattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctg

SEQ ID NO: 742 - DNA, 1385 bp, Curtobacterium sp.
cagtcgacgatgatgcccagcttgctgggtggattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaacgcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagcct

SEQ ID NO: 743 - DNA, 1400 bp, Microbacterium sp.
acatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgcccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaata

SEQ ID NO: 744 - DNA, 1413 bp, Curtobacterium sp.
agtcgaacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaaggcggccccctgggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatag

SEQ ID NO: 745 - DNA, 1395 bp, Bacillus sp.
ccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcga

SEQ ID NO: 746 - DNA, 1355 bp, Bacillus sp.
agcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtccact

SEQ ID NO: 747 - DNA, 1394 bp, Pseudomonas sp.
acatgcagtcgaacgatgatgcccagcttgctgggtggattagtggcgaacgggtcgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtc

SEQ ID NO: 748 - DNA, 1356 bp, Curtobacterium sp.
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccact

SEQ ID NO: 749 - DNA, 1386 bp, Erwinia sp.
tagcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagttcacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccta

SEQ ID NO: 750 - DNA, 1357 bp, Agrobacterium sp.
acatagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcca

SEQ ID NO: 751 - DNA, 1397 bp, Enterobacter sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcgatggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaa

SEQ ID NO: 752 - DNA, 1406 bp, Curtobacterium sp.
ccatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 753 - DNA, 1396 bp, Curtobacterium sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcga

SEQ ID NO: 754 - DNA, 1410 bp, Curtobacterium sp.
taccatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 755 - DNA, 1387 bp, Erwinia sp.
atgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagcctac

SEQ ID NO: 756 - DNA, 1351 bp, Curtobacterium sp.
aagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 757 - DNA, 1407 bp, Ochrobactrum sp.
accatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 758 - DNA, 1409 bp, Curtobacterium sp.
accatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcatacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactgt

SEQ ID NO: 759 - DNA, 1393 bp, Ochrobactrum sp.
cacatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcgaa

SEQ ID NO: 760 - DNA, 1397 bp, Rhodococcus sp.
ccatgcaagtcgaacgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaa

SEQ ID NO: 761 - DNA, 1357 bp, Ochrobactrum sp.
acatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 762 - DNA, 1393 bp, Microbacterium sp.
acatgcaagtcgaacgatgaagcccagcttgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 763 - DNA, 1419 bp, Achromobacter sp.
acatgcaagtcgaacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatatt

SEQ ID NO: 764 - DNA, 1357 bp, Microbacterium sp.
catgcaagtcgagcgccccgcaaggggagcggcagacgggtgagtaacgcgtgggcaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaacgcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 765 - DNA, 1409 bp, Achromobacter sp.
taccatgcaagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 766 - DNA, 1405 bp, Rhodococcus sp.
ccatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccat

SEQ ID NO: 767 - DNA, 1411 bp, Ochrobactrum sp.
catgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactagtag

SEQ ID NO: 768 - DNA, 1401 bp, Achromobacter sp.
gcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 769 - DNA, 1389 bp, Achromobacter sp.
acggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtatggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaagcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgagacc

SEQ ID NO: 770 - DNA, 1401 bp, Rhodococcus sp.
ccatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctggggccgtaactgacgctgaggagcgaaaggggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaat

SEQ ID NO: 771 - DNA, 1390 bp, Microbacterium sp.
aacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcggat

SEQ ID NO: 772 - DNA, 1364 bp, Ochrobactrum sp.
acacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtag

SEQ ID NO: 773 - DNA, 1401 bp, Curtobacterium sp.
aagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactg

SEQ ID NO: 774 - DNA, 1393 bp, Erwinia sp.
agtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgta

SEQ ID NO: 775 - DNA, 1399 bp, Ochrobactrum sp.
ggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggttatttaagtccgttgtgaaagcccctgggctcaacctgggaactgcagtggatactggatgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcagttagcttaaccttcgggagggcgc

SEQ ID NO: 776 - DNA, 1413 bp, Burkholderia sp.
cttaccatgcagtcgacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggtttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacggtag

SEQ ID NO: 777 - DNA, 1402 bp, Achromobacter sp.
atgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgaatacca

SEQ ID NO: 778 - DNA, 1399 bp, Achromobacter sp.
caagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 779 - DNA, 1406 bp, Achromobacter sp.
caagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccgggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacgtaga

SEQ ID NO: 780 - DNA, 1389 bp, Achromobacter sp.
tgacagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagc

SEQ ID NO: 781 - DNA, 1399 bp, Microbacterium sp.
tacacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaacccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtc

SEQ ID NO: 782 - DNA, 1364 bp, Achromobacter sp.
gacagtcgacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggt

SEQ ID NO: 783 - DNA, 1399 bp, Ochrobactrum sp.
atgacagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcgggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgat

SEQ ID NO: 784 - DNA, 1398 bp, Achromobacter sp.
acacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtgggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtc

SEQ ID NO: 785 - DNA, 1394 bp, Achromobacter sp.
aacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacg

SEQ ID NO: 786 - DNA, 1395 bp, Stenotrophomonas sp.
catgcaagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatcctggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgt

SEQ ID NO: 787 - DNA, 1382 bp, Achromobacter sp.
gaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggtaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagc

SEQ ID NO: 788 - DNA, 1400 bp, Achromobacter sp.
acacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaacgttaccaagggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 789 - DNA, 1359 bp, Achromobacter sp.
gaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagaaccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtg

SEQ ID NO: 790 - DNA, 1394 bp, Achromobacter sp.
ccatgcagtcgaacgatgaacctggagcttgctctgggggattagtggcgaacgggtgagtaacacgtgagcaacctgcccctgactctgggataagcgctggaaacggcgtctaatactggatacgaacaagaatcgcatggttacttgttggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacggaccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggcagcgataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagtcg

SEQ ID NO: 791 - DNA, 1351 bp, Microbacterium sp.
tgacagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctgggggagtacggtcgcaagattaaaactcaaaggaattgacgggggcccgcacaagcggtggagcatgtggtttaattcgaagcaacgcgcagaacccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcagtc

SEQ ID NO: 792 - DNA, 1335 bp, Microbacterium sp.
ttcgggagtcagcggcggacgggtgagtaacgcgtgggaacgtgccttccggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatcccgggacgataatgacggtaccgggaggaataagccccggctaacttcgtgcccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcagtc

SEQ ID NO: 793 - DNA, 1387 bp, Microbacterium sp.
cttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgag

SEQ ID NO: 794 - DNA, 1411 bp, Achromobacter sp.
gcagtcgagcggatgaagggagcttgctctctgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaacggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacgatg

SEQ ID NO: 795 - DNA, 1412 bp, Microbacterium sp.
ctcatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacggtagat

SEQ ID NO: 796 - DNA, 1396 bp, Achromobacter sp.
cgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccact

SEQ ID NO: 797 - DNA, 1391 bp, Microbacterium sp.
aagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 798 - DNA, 1398 bp, Microbacterium sp.
accatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacgggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 799 - DNA, 1362 bp, Microbacterium sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacgtac

SEQ ID NO: 800 - DNA, 1352 bp, Microbacterium sp.
tgacagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgggccaaccgcaaggaggcaggcgt

SEQ ID NO: 801 - DNA, 1357 bp, Microbacterium sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 802 - DNA, 1398 bp, Ochrobactrum sp.
atgacagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggtttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcga

SEQ ID NO: 803 - DNA, 1386 bp, Methylobacterium sp.
aagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccg

SEQ ID NO: 804 - DNA, 1361 bp, Pseudomonas sp.
agcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaa

SEQ ID NO: 805 - DNA, 1358 bp, Pseudomonas sp.
ttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaa

SEQ ID NO: 806 - DNA, 1354 bp, Achromobacter sp.
aacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttggggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaaggaagcaggcgaccacgtgt

SEQ ID NO: 807 - DNA, 1383 bp, Achromobacter sp.
tgacagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctataactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaaccccttgtgggagggag

SEQ ID NO: 808 - DNA, 1364 bp, Microbacterium sp.
acggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggcgtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaac

SEQ ID NO: 809 - DNA, 1381 bp, Microbacterium sp.
gagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtatacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaacctccgggagggc

SEQ ID NO: 810 - DNA, 1397 bp, Ochrobactrum sp.
agtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggaca

SEQ ID NO: 811 - DNA, 1363 bp, Methylobacterium sp.
gatgatcaggagcttgctcctgtgattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccct

SEQ ID NO: 812 - DNA, 1365 bp, Ochrobactrum sp.
gcgatgatcaggagcttgctcctgtgattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtaggggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccc

SEQ ID NO: 813 - DNA, 1349 bp, Achromobacter sp.
acagtcgagcgggcccttcgggagtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtgcacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggta

SEQ ID NO: 814 - DNA, 1363 bp, Microbacterium sp.
tgacagtcgagcggtaaggcctttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtc

SEQ ID NO: 815 - DNA, 1265 bp, Enterobacteriaceae
gattgctgggtggattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaac

SEQ ID NO: 816 - DNA, 1351 bp, Enterobacteriaceae
agacagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacggcggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgt

SEQ ID NO: 817 - DNA, 1412 bp, Sphingomonas sp.
catgcagtcgagcggatgagaggagcttgctcctctgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgg

SEQ ID NO: 818 - DNA, 1400 bp, Rhodococcus sp.
cgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacgtaga

SEQ ID NO: 819 - DNA, 1399 bp, Microbacterium sp.
gcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 820 - DNA, 1414 bp, Enterobacteriaceae
tgcagtcgaacggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggcttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgacc

SEQ ID NO: 821 - DNA, 1366 bp, Pseudomonas sp.
acggtgaagccaagcttgcttggtggatcagtggcgaacgggtgagtaacacgtgagcaacctgccctggactctgggataagcgctggaaacggcgtctaatactggatatgagcctcttccgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaaccctt

SEQ ID NO: 822 - DNA, 1355 bp, Curtobacterium sp.
ttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaga

SEQ ID NO: 823 - DNA, 1373 bp, Curtobacterium sp.
cagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctt

SEQ ID NO: 824 - DNA, 1402 bp, Methylobacterium sp.
acggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacggcggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgtcg

SEQ ID NO: 825 - DNA, 1363 bp, Rhodococcus sp.
agagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacgggcgcaaggttaaaactcaatgcatttgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtag

SEQ ID NO: 826 - DNA, 1304 bp, Curtobacterium sp.
catgcaagtcgagcgggcatccttgtggtgtcagcggcagacgggtgagtaacgcgtgggaacgtgcccttcggttcggaataactcagggaaacttgagctaataccggatacgtgcgagagcagaaaggtttactgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactgattggctcgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaatttgaagcaacgcgcagaaccttaccatcccttgacatggcatgcgagctggagagatcggctgttcccttcggggacgtgcacacaggtgctgcatggctgtcgtcagctcgtgtcgtgagatgttgggttaagtcccgcaacgagcgcaacccacgtcttcagttgccatcatttggttgggcactctggggagactgccggtgataagccgcgaggaaggtgtggatgacgtcaagtcttcatggcccttacgggatgggctacacacgtgctacaatggcggtgacaatgggcagcgaaggggcgacctggagagaatccccaaaagccgtctcagttcggattgcactctgcaactcgggtgcacgaaggcggaatcgctagtaatcgtggatcagcatgccacggtgaatacgttcccgggccttgtacacaccgcccgtcacacca

SEQ ID NO: 827 - DNA, 1213 bp, Ochrobactrum sp.
gctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcagccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcactagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcttcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagtt

SEQ ID NO: 828 - DNA, 1413 bp, Pseudomonas sp.
ccatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgga

SEQ ID NO: 829 - DNA, 1408 bp, Achromobacter sp.
caagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacga

SEQ ID NO: 830 - DNA, 1361 bp, Achromobacter sp.
gcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtatacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaga

SEQ ID NO: 831 - DNA, 1405 bp, Luteibacter sp.
gacagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtgggggagcaaacaggattagataccctggtagtccacgccgtaaacgatgtcaactagccgttgggatccttgagatcttagtggcgcagctaacgcattaagttgaccgcctgggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggta

SEQ ID NO: 832 - DNA, 1400 bp, Microbacterium sp.
agacagtcgaacggcagcataggagcttgctcctgatggcgagtggcgaacgggtgagtaatatatcggaacgtgccctagagtgggggataactagtcgaaagactagctaataccgcatacgatctacggatgaaagtgggggatcgcaagacctcatgctcctggagcggccgatatctgattagctagttggtggggtaaaagcctaccaaggcaacgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggtagtagctaatatctattactaatgacggtacctgaagaataagcaccggctaactacgtgccagcagccgcggtaatacgtagggtgcaagcgttaatcggaattactgggcgtaaagcgtgcgcaggcggttgtgtaagtcagatgtgaaatccccgggctcaaccctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggatggaatcccgaagagatttgggagtgctcgaaagagaaccatcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtgggtagcctaaccgcaaggagggcgta

SEQ ID NO: 833 - DNA, 1344 bp, Enterobacteriaceae
agattgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtatacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtgg

SEQ ID NO: 834 - DNA, 1412 bp, Curtobacterium sp.
tgacagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttgggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgta

SEQ ID NO: 835 - DNA, 1364 bp, Luteibacter sp.
agagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtaag

SEQ ID NO: 836 - DNA, 1380 bp, Enterobacteriaceae
tgacagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctgggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtg

SEQ ID NO: 837 - DNA, 1418 bp, Methylobacteriaceae
cacatgcagtcggacggtagcacagagagagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtatacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaaccttcgggagggcgctaccact

SEQ ID NO: 838 - DNA, 1343 bp, Methylobacterium sp.
tcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccaca

SEQ ID NO: 839 - DNA, 1386 bp, Pseudomonas sp.
tgacagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggag

SEQ ID NO: 840 - DNA, 1363 bp, Pseudomonas sp.
agagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtat

SEQ ID NO: 841 - DNA, 1352 bp, Enterobacteriaceae
tgacagtcgagcggacctttcgggagtcagcggcggacgggtgagtaacgcgtgggaacgtgccttccggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggtg

SEQ ID NO: 842 - DNA, 1335 bp, Pseudomonas sp.
gatgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtagg

SEQ ID NO: 843 - DNA, 1422 bp, Herbaspirillum sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtggggacagagggctgcaagccggcgacggtaagccaatcccagaaaccccatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 844 - DNA, 1406 bp, Curtobacterium sp.
taccatgcagtcgaacggtaacaggtcttcggatgctgacgagtggcgaacgggtgagtaatacatcggaacgtgcccgatcgtgggggataacgaggcgaaagctttgctaataccgcataagatctatggatgaaagcaggggaccgcaaggccttgcgcgaacggagcggccgatggcagattaggtagttggtggggtaaaggcttaccaagcctacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagccttcttctaataaagggaggtcatgacggtaccgtaagaataagcaccggctaactacgtgccagcagccgcggtaatacgtagggtgcaagcgttaatcggaattactgggcgtaaagcgtgcgcaggcggtgatgtaagacagatgtgaaatccccgggctcaacctgggaactgcatttgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagctaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgctaccacta

SEQ ID NO: 845 - DNA, 1360 bp, Xanthomonas sp.
atagcagtcgaacgatgctttcgggcatagtggcgcacgggtgcgtaacgcgtgggaatctgcccttgggtctgggataacagttggaaacgactgctaataccggatgatatcgcgagatcaaagatttatcgcccgaggatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgggattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactgggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcgactacagtgggctgcaatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaacctcgcaagaggaggcaggcgac

SEQ ID NO: 846 - DNA, 1406 bp, Enterobacteriaceae
acatgcaagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggactct

SEQ ID NO: 847 - DNA, 1365 bp, Curtobacterium sp.
cacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagcccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgt

SEQ ID NO: 848 - DNA, 1383 bp, Enterobacteriaceae
tcgaacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccg

SEQ ID NO: 849 - DNA, 1422 bp, Agrobacterium sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacta

SEQ ID NO: 850 - DNA, 1299 bp, Curtobacterium sp.
tcagcggcggacgggtgagtaacgcgtggtaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcg

SEQ ID NO: 851 - DNA, 1337 bp, Enterobacteriaceae
gacagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaacctgc

SEQ ID NO: 852 - DNA, 1397 bp, Methylobacterium sp.
accatgcaagtcgaacggtgaagccaagcttgcttggtggatcagtggcgaacgggtgagtaacacgtgagcaacctgccctggactctgggataagcgctggaaacggcgtctaatactggatatgagctcctatcgcatggtgggggttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgagagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaaggcttgacatacatcagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcg

SEQ ID NO: 853 - DNA, 1356 bp, Enterobacteriaceae
catgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgtcca

SEQ ID NO: 854 - DNA, 1362 bp, Xanthomonas sp.
ccatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccactgt

SEQ ID NO: 855 - DNA, 1411 bp, Acidovorax sp.
cacatgcagtcggacggtagcacagagagagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaaccttcgggagggcgc

SEQ ID NO: 856 - DNA, 1412 bp, Sphingomonas sp.
acatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacta

SEQ ID NO: 857 - DNA, 1354 bp, Pseudomonas sp.
cagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaaggggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccac

SEQ ID NO: 858 - DNA, 1403 bp, Sphingomonas sp.
cgcatgcagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtc

SEQ ID NO: 859 - DNA, 1411 bp, Curtobacterium sp.
acatgcagtcggacggtagcacagagaagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaacctccgggagggcgct

SEQ ID NO: 860 - DNA, 1395 bp, Xanthomonas sp.
cagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacgg

SEQ ID NO: 861 - DNA, 1391 bp, Methylobacterium sp.
acatgcagtcgacgatgaagcccagcttgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaatttcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccg

SEQ ID NO: 862 - DNA, 1401 bp, Methylobacterium sp.
gcagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtaggggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcac

SEQ ID NO: 863 - DNA, 1369 bp, Microbacterium sp.
acacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggtgtc

SEQ ID NO: 864 - DNA, 1398 bp, Methylobacterium sp.
cgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacggt

SEQ ID NO: 865 - DNA, 1415 bp, Agrobacterium sp.
gcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacg

SEQ ID NO: 866 - DNA, 1402 bp, Enterobacteriaceae
tcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcgggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtgggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactgta

SEQ ID NO: 867 - DNA, 1407 bp, Pseudomonas sp.
gcatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 868 - DNA, 1378 bp, Methylobacterium sp.
ccatgcagtcgacgatgatcaggagcttgctcttgtgattagtggcgaacgggtgagtaacacgtgagtaacctgcccctgactctgggataagcgttggaaacgacgtctaatactggataggactactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacgggcgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttg

SEQ ID NO: 869 - DNA, 1409 bp, Burkholderia sp.
gcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccactga

SEQ ID NO: 870 - DNA, 1371 bp, Erwinia sp.
gcagtcgacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaatactcaaaggaattgacgggggcccgcacaagcggcggagcatgcggattaattcgatgcaacgcgaagaaccttaccaaggcttgacatacaccggaaacagccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccc

SEQ ID NO: 871 - DNA, 1424 bp, Burkholderia sp.
acatgcagtcgaacggcagcaacaggagagcttgctctctgggtggcgagtggcggacgaggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtgggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 872 - DNA, 1350 bp, Curtobacterium sp.
agcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgt

SEQ ID NO: 873 - DNA, 1397 bp, Burkholderia sp.
cagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcgggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatac

SEQ ID NO: 874 - DNA, 1409 bp, Sphingomonas sp.
atgcagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccact

SEQ ID NO: 875 - DNA, 1393 bp, Achromobacter sp.
cacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttcgccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagcc

SEQ ID NO: 876 - DNA, 1362 bp, Xanthomonas sp.
aagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtat

SEQ ID NO: 877 - DNA, 1403 bp, Achromobacter sp.
catgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacgg

SEQ ID NO: 878 - DNA, 1390 bp, Achromobacter sp.
gaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacgc

SEQ ID NO: 879 - DNA, 1379 bp, Curtobacterium sp.
aagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggag

SEQ ID NO: 880 - DNA, 1383 bp, Pseudomonas sp.
gacagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagcc

SEQ ID NO: 881 - DNA, 1360 bp, Curtobacterium sp.
agcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcagcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagta

SEQ ID NO: 882 - DNA, 1384 bp, Xanthomonas sp.
gcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaaccccttgtgggagggagccg

SEQ ID NO: 883 - DNA, 1355 bp, Ochrobactrum sp.
atagcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggagagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacc

SEQ ID NO: 884 - DNA, 1383 bp, Achromobacter sp.
tgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttcctttccacggaatccgtgccgtagctaacgcattaagcgcccggcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagc

SEQ ID NO: 885 - DNA, 1363 bp, Pseudomonas sp.
ttaccatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgcccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactg

SEQ ID NO: 886 - DNA, 1390 bp, Microbacterium sp.
acatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcg

SEQ ID NO: 887 - DNA, 1406 bp, Enterobacteriaceae
cgtacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttgcagagatggtttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 888 - DNA, 1345 bp, Pseudomonas sp.
tgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaacctgcaaggagg

SEQ ID NO: 889 - DNA, 1366 bp, Burkholderia sp.
agtcgagcggtaggcctttcggggtcacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcgtgaaagtcggtaacacccgaagccggtggcttaaccccttg

SEQ ID NO: 890 - DNA, 1343 bp, Rhodococcus sp.
cgtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcagggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaatactcaaaggaattgacgggggcccgcacaagcggtggagcatgtggtttaattcgaagcaacgcgcagaaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggc

SEQ ID NO: 891 - DNA, 1361 bp, Rhodococcus sp.
cacatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacta

SEQ ID NO: 892 - DNA, 1365 bp, Pantoea sp.
taagcttgctcttcgggtgacgagtggcggacgggtgagtaatgtctgggaaactgcccgatggcgggggataactactggaaacggtagctaataccgcataacgtcgcaagaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtaaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggctttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgggtagtgccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtagtaa

SEQ ID NO: 893 - DNA, 1351 bp, Rhodococcus sp.
agcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtc

SEQ ID NO: 894 - DNA, 1387 bp, Ochrobactrum sp.
actgcagtcgagcggtaaggcctttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaaccccttgtgggagggagcc

SEQ ID NO: 895 - DNA, 1356 bp, Rhodococcus sp.
ctagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaagcaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgt

SEQ ID NO: 896 - DNA, 1388 bp, Ochrobactrum sp.
ccatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtcccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccg

SEQ ID NO: 897 - DNA, 1355 bp, Rhodococcus sp.
atagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcca

SEQ ID NO: 898 - DNA, 1352 bp, Enterobacteriaceae
aagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccac

SEQ ID NO: 899 - DNA, 1383 bp, Ochrobactrum sp.
atgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagc

SEQ ID NO: 900 - DNA, 1389 bp, Rhodococcus sp.
cttgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtc

SEQ ID NO: 901 - DNA, 1389 bp, Ochrobactrum sp.
accatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgt

SEQ ID NO: 902 - DNA, 1360 bp, Ochrobactrum sp.
catgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgc

SEQ ID NO: 903 - DNA, 1418 bp, Erwinia sp.
cacatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccact

SEQ ID NO: 904 - DNA, 1434 bp, Ochrobactrum sp.
atacatgcagtcgagcggacttgcatgagaagcttgcttctcatgataggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttagggggtttcgatacccttggtgccgaagttaacacattaagcactccgcctggggagtacaggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatg

SEQ ID NO: 905 - DNA, 1425 bp, Rhodococcus sp.
gagcggacttgcatgagaagcttgcttctctgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttgggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgat

SEQ ID NO: 906 - DNA, 1393 bp, Ochrobactrum sp.
tgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttagggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtg

SEQ ID NO: 907 - DNA, 1407 bp, Rhodococcus sp.
agaagcttgcttctcatgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatgt

SEQ ID NO: 908 - DNA, 1429 bp, Ochrobactrum sp.
atactgcagtcgagcggacttgatgagaagcttgcttctctgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgatactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaag

SEQ ID NO: 909 - DNA, 1421 bp, Ochrobactrum sp.
atgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcct

SEQ ID NO: 910 - DNA, 1433 bp, Rhodococcus sp.
tatacatgcagtcgagcggacttgcatgagaagcttgcttctcatgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacacccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccga

SEQ ID NO: 911 - DNA, 1413 bp, Rhodococcus sp.
atgcatgagaagcttgcttctcatgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaat

SEQ ID NO: 912 - DNA, 1437 bp, Rhodococcus sp.
tatacatgcagtcgagcggactatgcatgagaagcttgcttctcatgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtg

SEQ ID NO: 913 - DNA, 1427 bp, Ochrobactrum sp.
tatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaacccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgc

SEQ ID NO: 914 - DNA, 1430 bp, Enterobacteriaceae
acatgcagtcgagcggacttgatgagaagcttgcttctctgatggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtg

SEQ ID NO: 915 - DNA, 1422 bp, Paenibacillus sp.
cacatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttt

SEQ ID NO: 916 - DNA, 1416 bp, Paenibacillus sp.
acatgcagtcggacggtagcacagagaagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaaccttcgggagggcgctaccacg

SEQ ID NO: 917 - DNA, 1379 bp, Paenibacillus sp.
acatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttg

SEQ ID NO: 918 - DNA, 1381 bp, Paenibacillus sp.
ccatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggtaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtg

SEQ ID NO: 919 - DNA, 1422 bp, Paenibacillus sp.
cacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaaccctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 920 - DNA, 1381 bp, Bacillus sp.
accatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtcccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttg

SEQ ID NO: 921 - DNA, 1394 bp, Paenibacillus sp.
taccatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggccagagatggttgccccctttgtggtccggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 922 - DNA, 1424 bp, Paenibacillus sp.
cacatgcaagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagcccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 923 - DNA, 1423 bp, Paenibacillus sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaaagggtgcaagcgttactcggaattactgggcgtaaagcgtgcgtaggtggttgtttaagtccgttgtgaaagccctgggcttaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaagcttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacg

SEQ ID NO: 924 - DNA, 1381 bp, Bacillus sp.
gcatgcagtcgacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtgg

SEQ ID NO: 925 - DNA, 1374 bp, Paenibacillus sp.
gcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctt

SEQ ID NO: 926 - DNA, 1415 bp, Enterobacteriaceae
ccatgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacacacatgggagtgggttgcaaaagaagtaggtagcttaaccttcgggagggcgcttac

SEQ ID NO: 927 - DNA, 1415 bp, Enterobacteriaceae
cacatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggtattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacca

SEQ ID NO: 928 - DNA, 1412 bp, Curtobacterium sp.
catgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactttaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgct

SEQ ID NO: 929 - DNA, 1406 bp, Curtobacterium sp.
cacatgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaaccctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacg

SEQ ID NO: 930 - DNA, 1423 bp, Xanthomonas sp.
aacacatgcaagtcgaacggcagcaacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgacc

SEQ ID NO: 931 - DNA, 1405 bp, Curtobacterium sp.
tgcaagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtac

SEQ ID NO: 932 - DNA, 1411 bp, Curtobacterium sp.
caagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctactcttgacatccacggaattcgggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacacgcatgggagtgggttgcaaaagaagtaggtagcttaacctccgggagggcgcttac

SEQ ID NO: 933 - DNA, 1368 bp, Xanthomonas sp.
acacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggtgt

SEQ ID NO: 934 - DNA, 1417 bp, Xanthomonas sp.
catgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccatc

SEQ ID NO: 935 - DNA, 1363 bp, Curtobacterium sp.
acatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggataagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacag

SEQ ID NO: 936 - DNA, 1416 bp, Curtobacterium sp.
acatgcaagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcatatgaattgacgggggcccgcacaagcggtggagcatgtggtttaattcgaagcaacgcgaagaaccttacctgggccttgacatgctgagaactttccagagatggattgggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacgga

SEQ ID NO: 937 - DNA, 1403 bp, Enterobacteriaceae
gcaagtcgagcggatgagaggggcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtt

SEQ ID NO: 938 - DNA, 1393 bp, Enterobacteriaceae
agtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccggaaacgggcagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaat

SEQ ID NO: 939 - DNA, 1412 bp, Xanthomonas sp.
caagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaagggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccat

SEQ ID NO: 940 - DNA, 1392 bp, Pseudomonas sp.
acatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaagcttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 941 - DNA, 1394 bp, Luteibacter sp.
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccgggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggctcagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcg

SEQ ID NO: 942 - DNA, 1402 bp, Pseudomonas sp.
tacacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaat

SEQ ID NO: 943 - DNA, 1393 bp, Enterobacteriaceae
cacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccg

SEQ ID NO: 944 - DNA, 1389 bp, Sphingomonas sp.
cacatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcgggggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggag

SEQ ID NO: 945 - DNA, 1368 bp, Enterobacteriaceae
tacacatgcaagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgg

SEQ ID NO: 946 - DNA, 1400 bp, Sphingomonas sp.
taccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggctgagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaagg

SEQ ID NO: 947 - DNA, 1405 bp, Pseudomonas sp.
gcagtcggacggtagcacagaggagctttgctcctcgggtgacgagtggcggcacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgactttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtctcaccatgggagtgggttgcaaaagaagtaggtagcttaaccttcgggaggg

SEQ ID NO: 948 - DNA, 1416 bp, Pseudomonas sp.
tgcaagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggtatggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccac

SEQ ID NO: 949 - DNA, 1358 bp, Curtobacterium sp.
cacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaaggaagcaggcgac

SEQ ID NO: 950 - DNA, 1415 bp, Enterobacteriaceae
catgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggatctaattccaggtgtagcggtgaaatgcgtagagatctggaggaataccggtggcgaaggcggccccctggacgaagactgacgctcacgtgcgaaagcgtggggagcaaacacgattacataccctggtagtccacgccgtatacgatgtcgacttggaggttgttcccttgacgagtgccttccggagctaacgcgttaagtcgaccgcctggcgagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacagcacatgggagtgggttgcaaaagaagtaggtagcttaacctccgggagggcgctta

SEQ ID NO: 951 - DNA, 1374 bp, Curtobacterium sp.
agtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaaatcatgaaagtcggtaacacccgaagccggtggcctaacccttgt

SEQ ID NO: 952 - DNA, 1388 bp, Curtobacterium sp.
caagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggatcgccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 953 - DNA, 1374 bp, Curtobacterium sp.
cagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaacagtcggtaacacccgaagccggtggcctaaccctt

SEQ ID NO: 954 - DNA, 1386 bp, Curtobacterium sp.
acacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtgga

SEQ ID NO: 955 - DNA, 1393 bp, Curtobacterium sp.
tacacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaagagcc

SEQ ID NO: 956 - DNA, 1392 bp, Sphingomonas sp.
acacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 957 - DNA, 1401 bp, Curtobacterium sp.
tacacatgcaagtcgaacggtgaagccaagcttgcttggtggatcagtggcgaacgggtgagtaacacgtgagcaacctgccctggactctgggataagcgctggaaacggcgtctaatactggatatgagcctcttccgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaat

SEQ ID NO: 958 - DNA, 1367 bp, Enterobacteriaceae
acgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctgt

SEQ ID NO: 959 - DNA, 1347 bp, Xanthomonas sp.
gcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaaggaagca

SEQ ID NO: 960 - DNA, 1384 bp, Sphingomonas sp.
cagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctgtggaagagccg

SEQ ID NO: 961 - DNA, 1364 bp, Enterobacteriaceae
acacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagccctggagctcaactccagaactgcctttgagactgcatcgcttgaatcccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactgggaaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaaggaagcaggcgacc

SEQ ID NO: 962 - DNA, 1376 bp, Curtobacterium sp.
aagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtg

SEQ ID NO: 963 - DNA, 1386 bp, Curtobacterium sp.
caagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctgtggaaggagccg

SEQ ID NO: 964 - DNA, 1396 bp, Curtobacterium sp.
gcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggagg

SEQ ID NO: 965 - DNA, 1395 bp, Curtobacterium sp.
atgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtctatccatgggagtgggttgcaaaagaagtaggtagctaactc

SEQ ID NO: 966 - DNA, 1430 bp, Curtobacterium sp.
atacatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaacccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctatg

SEQ ID NO: 967 - DNA, 1416 bp, Curtobacterium sp.
acatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaatactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccgt

SEQ ID NO: 968 - DNA, 1417 bp, Microbacterium sp.
acatgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccata

SEQ ID NO: 969 - DNA, 1405 bp, Curtobacterium sp.
atgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaagctttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagg

SEQ ID NO: 970 - DNA, 1412 bp, Sphingomonas sp.
acatgcaagtcggacggtagcacagaggaagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgct

SEQ ID NO: 971 - DNA, 1337 bp, Curtobacterium sp.
cacatgcaagtcgagcgggcatccttgtggtgtcagcggcagacgggtgagtaacgcgtgggaacgtgcccttcggttcggaataactcagggaaacttgagctaataccggatacgtgcgagagcagaaaggtttactgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactgattggctcgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgcgagccggagagatccggtgttcccttcggggacgtgcacacaggtgctgcatggctgtcgtcagctcgtgtcgtgagatgttgggttaagtcccgcaacgagcgcaacccacgtcctcagttgccatcatttggttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgc

SEQ ID NO: 972 - DNA, 1395 bp, Sphingomonas sp.
ccatgcaagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttgggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtc

SEQ ID NO: 973 - DNA, 1405 bp, Curtobacterium sp.
gcaagtcggacggtagcacagaagagcttgctcttcgggtgacgagtggcggacgggtgagtaatgtctgggaaactgcccgatggagggggataactactggaaacggtagctaataccgcataacgtcttcggaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggccttgacatccacggaacttggcagagatgccttggtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaacctccgggagggc

SEQ ID NO: 974 - DNA, 1401 bp, Curtobacterium sp.
cacatgcaagtcgaacggtaacaggtcttcggatgctgacgagtggcgaacgggtgagtaatacatcggaacgtgcccaagagtgggggataacggagcgaaagctttgctaataccgcatacgatctacggatgaaagcaggggaccgcaaggccttgcgctcatggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagcctctttctaataaagaggggtcatgacggtaccgtaagaataagcaccggctaactacgtgccagcagccgcggtaatacgtagggtgcgagcgttaatcggaattactgggcgtaaagcgtgcgcaggcggtaatgtaagacagatgtgaaatccccgggctcaacctgggaactgcatttgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagctaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgctca

SEQ ID NO: 975 - DNA, 1410 bp, Pseudomonas sp.
tgcagtcggacggtagcacagaagagcttgctcttcgggtgacgagtggcggacgggtgagtaatgtctgggaaactgcccgatggagggggataactactggaaacggtagctaataccgcataacgtcttcggaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctgggggagtacggccgcaaggttaaaactcaaatgaattgacgggggcccgcacaagcggtggagcatgtggtttaattcgatgcaacgcgaagaaccttacctggccttgacatccacggaacttggcagagatgccttggtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccgatgggagtgggttgcaaaagaagtaggtagcttaaccttcgggagggcgcct

SEQ ID NO: 976 - DNA, 1414 bp, Enterobacteriaceae
atgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggacgaataccggtggcgaaggcggccccctggacgaagactgacgctcacgtgcgaaagcgtggggagcaaacacgattacataccctggtagtccacgccgtaaacgatgtcgacttggacgttgttcccttgacgagtggcttccggagctaacgcgttaagtcgaccgcctggcgagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccata

SEQ ID NO: 977 - DNA, 1406 bp, Bacillus sp.
atgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctgggcatgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttac

SEQ ID NO: 978 - DNA, 1384 bp, Pantoea sp.
gaagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggagga

SEQ ID NO: 979 - DNA, 1406 bp, Enterobacteriaceae
atgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattgggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggta

SEQ ID NO: 980 - DNA, 1431 bp, Enterobacteriaceae
acatgcaagtcgagcggacttgcatgagaagcttgcttctcatgataggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgata

SEQ ID NO: 981 - DNA, 1426 bp, Enterobacteriaceae
tacatgcaagtcgagcgaacagacgaggagcttgctcctttgacgttagcggcggacgggtgagtaacacgtgggtaacctacctataagactgggataacttcgggaaaccggagctaataccggataatatttcgaaccgcatggttcgatagtgaaagatggctctgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacatgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcga

SEQ ID NO: 982 - DNA, 1389 bp, Enterobacteriaceae
agacgaggagcttgctcctttgacgttagcggcggacgggtgagtaacacgtgggtaacctacctataagactgggataacttctggaaaccggagctaataccggataatatttcgaaccgcatggttcgatagtgaaagatggctctgctatcacttatagatggacctgcgccgtattatctagttggtaaggtaacggcttaccaaggcaacgatacgtagccgacctgagagggtgatcggccacactggaactgagacacgggccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtctctccggcgagagtttgtaacacccgaagccggtggagtaacca

SEQ ID NO: 983 - DNA, 499 bp, Microbacterium sp.
gaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtttggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgta

SEQ ID NO: 984 - DNA, 740 bp, Erwinia sp.
  misc_feature 4, 7, 10, 15, 18, 613, 636, 638, 677, 691, 708: N is A,T,C or G
cganacnggnagccntanaacacatgcaagtcgaacgatgaactccagcttgctggggggattagtggcgaacgggtgagtaacacgtgagtaacctgcccttgactctgggataagcgctggaaacggcgtctaataccggatacgagcttcagccgcatggctaggagttggaaagaatttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggnagattggaattcctggtgtagcngngggaatgcgcagatatcaggaggaacaccgatggcgaangcagatctctgggnccgtaactgacgctgangagcgaaagcgtggggagcgaacaggattaga

SEQ ID NO: 985 - DNA, 560 bp, Acidovorax sp.
  misc_feature 146, 237, 417, 418, 428, 432: N is A,T,C or G
cgctggcggcatgctttacacatgcaagtcgaacggcagcgcggggcaacctggcggcgagtggcgaacgggtgagtaatatatcggaacgtacccaagagtgggggataacgtagcgaaagttacgctaataccgcatacgatcnaaggatgaaagcaggggatcttcggaccttgtgctcctggagcggccgatatctgattagctagttggtgaggtaaaggctcaccaaggcnacgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtnngggctaatancctnagctaatgacggtacctgaagaataagcaccggctaactacgtgccagcagccgcggtaatacgtagggtgcaagcgttaatcggaattactgggcgtaaagcgtgcgcaggcggttttgtaagtctg

SEQ ID NO: 986 - DNA, 740 bp, Erwinia sp.
  misc_feature 2, 113, 172, 626, 685, 692, 693, 695, 702, 708, 729: N is A,T,C or G
cnacgctggcggctgcctaatacatgcaagtcgagcggacttgaagagaagcttgcttctccgatggttagcggcggacgggtgagtaacacgtaggcaacctgccctcaagnttgggacaactaccggaaacggtagctaataccgaatagttgttttcttctcctgaagnaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggntgacttgagtgcagaagaggagagtggaattccacgtgtagcggtgaaatgcgtagaanttttggnngnacccccngtggcnaaaggcgactctctgggctgnaactgacgctg

SEQ ID NO: 987 - DNA, 509 bp, Enterobacteriaceae
gtcgaacgaaggcttcggccttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactct

SEQ ID NO: 988 - DNA, 740 bp, Pseudomonas sp.
  misc_feature 2, 4, 5, 10, 11, 683: N is A,T,C or G
cnannctggnngcctgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagantttggaggaacaccagtggcgaaggcgactttctggtctgtaactgacactgaggcg

SEQ ID NO: 989 - DNA, 478 bp, Pseudomonas sp.
gccttcgggagctctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacag

SEQ ID NO: 990 - DNA, 725 bp, Pseudomonas sp.
  misc_feature 5, 676, 701, 704, 709, 723: N is A,T,C or G
gctangctggcggcgtgcttacacatgcaagtcgaacggtgaagccaagcttgcttggtggatcagtggcgaacgggtgagtaacacgtgagcaacctgccctggactctgggataagcgctggaaacggcgtctaatactggatatgagctcctatcgcatggtgggggttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgagagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaangcagatctctgggccgtaactgacnctnaagancgaaagggtggggnag

SEQ ID NO: 991 - DNA, 725 bp, Paenibacillus sp.
  misc_feature 5, 6, 603, 637, 652, 679, 704, 707: N is A,T,C or G
gctannctggcggcgtgcttacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtttggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactanagtgcggtaggggagattggaattcctggtgtancggtggaatgcgcanatttcaggaggaacaccgatggcgaangcagatctctgggccgtaactgacnctnaagaacgaaagggtgggg

SEQ ID NO: 992 - DNA, 725 bp, Staphylococcus sp.
  misc_feature 5, 6, 703, 706, 708, 711: N is A,T,C or G
gctannctggcggcgtgcttaccatgcaagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtttggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtacctgacnctnangancgaaagggtgggga

SEQ ID NO: 993 - DNA, 740 bp, Staphylococcus sp.
  misc_feature 677, 682, 683, 685, 697, 705, 708, 709, 717, 735, 737, 739: N is A,T,C or G
ctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggaggagtggaattccacgtgtagcggtgaaatgcgtaganaatgnngnaggaacaccagntggcgaanggnnactctctnggtctgtaactgacgctnangna

SEQ ID NO: 994 - DNA, 1534 bp, Microbacterium sp.
  misc_feature 11, 68, 711, 712, 713, 714, 715, 716, 717, 718, 719, 720, 721, 744, 762, 763: N is A,T,C or G
agagtttgatnatggctcagattgaacgctggcggcaggcctaacacatgcaagtcgagcggcagcgnaaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcatacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaatnnnnnnnnnnnaggcggccccctggacaaagacngacgctcaggtgcgaaanngtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcgccagagatggcttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacttcgggagggcgcttaccactttgtgattcatgactggggtgaagtcgtaacaaggtaaccgtaggggaactgcggttggatcacctcctta

SEQ ID NO: 995 - DNA, 661 bp, Frigoribacterium sp.
aacgctggccggcaggcctaactacatgcaagtcgcagcggtagcacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcgg

SEQ ID NO: 996 - DNA, 523 bp, Uncultured proteobacterium
  Uncultured seed derived bacterium of the family
agagtttgatcatggctcagattgaacgctggcggcaggcctaacacatgcaagtcgagcggatgaagagagcttgctctctgattcagcggcggacgggtgagtaatgcctaggaatctgcctggtagtgggggacaacgtctcgaaagggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagcgaataccttgctgttttgacgttaccgacagaataagcaccggctaactctgtgccagcagccgcggtaatac

SEQ ID NO: 997 - DNA, 525 bp, Paenibacillus sp.
agagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatac

SEQ ID NO: 998 - DNA, 523 bp, Sphingomonas  sp.
agagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatac

SEQ ID NO: 999 - DNA, 1371 bp, Bacillus sp.
agtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtacattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagcc

SEQ ID NO: 1000 - DNA, 846 bp, Pantoea ananatis
gaaacgactgctaagactggataggaaacagagaggcatctttttgtttttaaaagaccttcttcggagggtatgcttaaagaggggcttgcgccacattagttagttggtgaggtaaaggcttaccaagattatgatgtgtagctggactgagaggttgaacagccacattgggactgagacacggcccaaactcctacgggaggcagcagtagggaattttcggcaatggaggaaactctgaccgagcgacgccgcgtgaacgatgaagtatttcggtatgtaaagttcttttattgaagaagaaaaaatagtggaaaaactatcttgacgttattcaatgaataagccccggctaactatgtgccagcagccgcggtaagacatagggggcgagcgttatccggaattattgggcgtaaagggtgcgtaggcggttagataagtctataatttaatttcagtgcttaacgctgtcttgttatagaaactgtcttgactagagtgagataggggcaagcggaattccatgtgtagcggtaaaatgtgtaaatatatggaggaacaccagaagcgtagggcggcttgctgggtctttactgacgctgaggcacgaaagcgtggggagcaaacaggattagataccctggtagtccacgctgtaaacgatgagtactaagtgtcggggtaactcggtactgaagttaacacattaagtactccgcctgagtagtacgtacgcaagtatgaaacttaaaggaattgacgggactcgcacaagcggtggatcatgtgtttaattcgaagatacacgaagaaccttaccaggtcttgacatactctgcg

SEQ ID NO: 1001 - DNA, 860 bp, Microbacterium sp.
gaacgactcgctatagactggataggaaacagaaaggcatctttttgtttttaaaagaccttcttcggagggtatgcttaaagaggggcttgcgccacattagttagttggtgaggtaaaggcttaccaagattatgatgtgtagctggactgagaggttgaacagccacattgggactgagacacggcccaaactcctacgggaggcagcagtagggaattttcggcaatggaggaaactctgaccgagcgacgccgcgtgaacgatgaagtatttcggtatgtaaagttcttttattgaagaagaaaaaatagtggaaaaactatcttgacgttattcaatgaataagccccggctaactatgtgccagcagccgcggtaagacatagggggcgagcgttatccggaattattgggcgtaaagggtgcgtaggcggttagataagtctataatttaatttcagtgcttaacgctgtcttgttatagaaactgtcttgactagagtgagatagaggcaagcggaattccatgtgtagcggtaaaatgtgtaaatatatggaggaacaccagaagcgtaggcggcttgctgggtctttactgacgctgaggcacgaaagcgtggggagcaaacaggattagataccctgggtagtccacgctgtaaacgatgagtactaagtgtcggggtaactcgggtactgaagttaacacattaagtactccgcctgagtagtacgtacgcaagtatgaaacttaaaggaattgacgggactccgcacaagcgtggatcatgttgtttaattcgaagatacacgaaaaaccttaccaggtcttgacatactctggcaaagcttatag

SEQ ID NO: 1002 - DNA, 895 bp, Microbacterium sp.
ggggggctaaccatgcagtcggacggtagcacagagagcttgctctcgggtgacgagtggcggacgggtgagtaatgtctggggatctgcccgatagagggggataactactggaaacggtagctaataccgcatgacctcgtaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggagtaccggtggcgaaggcggccccctggacaaagactgacgctcaggtgcgaaagcgtggggagcaaacaggattagataccctggtagtccacgccgtaacgatgtcgacttggaggttgttcccttgaggagtgcttccggagctaacgcgttaagtcgaccgcctgggggagtacggccgcaaggttaaaactcaaatgaatttgacgggggcccgcacaagc

SEQ ID NO: 1003 - DNA, 782 bp, Microbacterium sp.
gtcggacggtagcacagaggagtttgcttcttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggtgaggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttccctt

SEQ ID NO: 1004 - DNA, 739 bp, Bacillus pumilus
tggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggt

SEQ ID NO: 1005 - DNA, 800 bp, Rahnella aquatilis
tgcattaccatgcagtcgacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgc

SEQ ID NO: 1006 - DNA, 770 bp, Enterobacter sp.
tgcagtcgacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacactcgatggcgaaggcagatctctgggctcgtaactgacgctgaggagcgaaagcatggggagcgaacaggattagatactctggctagtccatgccgtaaacgttgggcgctagatgtagggatcttttcca

SEQ ID NO: 1007 - DNA, 760 bp, Pseudomonas sp.
gtcgacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcagaggaacaccgatggcgaaggcagatctctgggccgtaactgacgctgaggagcgaaagcgtggggagcgaacaggattagataccctggtagtccacgccgtaaacgttgggcgctagatgtagggaccttttc

SEQ ID NO: 1008 - DNA, 770 bp, Pseudomonas syringae
tgcagtcgacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggctcgtaactgacgctgaggagcgaaagcatggggagcgaacaggattagataccctggtagtccatgccgtaaacgttgggcgctagatgtagggacctttccacgg

SEQ ID NO: 1009 - DNA, 747 bp, Pseudomonas sp.
ttgctactttgccggcgagcggcggacgggtgagtaatgtctgggaaactgcctgatggagggggataactactggaaacggtagctaataccgcatgacctcgtaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccgtgccgcgtgtgtgaagaaggccttagggttgtaaagcactttcagcgaggaggaagggttcagtgttaatagcactgtgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttgg

SEQ ID NO: 1010 - DNA, 916 bp, Pseudomonas putida
tggttccagggtttgaaacgccctggcgccaggccttaacacattgcagttcgagcggcagcgggaggtaagctgctacttggccgtcggagccggcggacgggtgagtaagtctgggaactgcttgatggaggggggataactactggaacggtagctaataccggcatgacctcgcaagagcaaagtgggggaccttccgggcctcacgccatcggatgtgcccagatgggattagctagtaggtgaggtaatggctcacctaggcgacgatccctagctggtctgagaggatgaccagccacactggaactgagacacggtccagactctacgggaggcagcagtggggaatattgcacaatgggcgcaagcctgatgcagccatgccgcgtgtgtgaagaaggccttagggttgtaaagcactttcagcgaggaggaagggttcagtgttaatagcactgtgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggtgtggcttccggagctaacgcgttaagtcgaccgcctggggagtacggccgcaaggttcaaactcaaatgaattgacgg

SEQ ID NO: 1011 - DNA, 780 bp, Phytoplasma vitis
gtcgacggtagcacagagagcttgctcttgggtgacgagtggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtggggaggaaggcgaagaggttaataaccttttcgattgacgttacccgcagaagaagcaccggctaactccgtgccagcagccgcggtaatacggagggtgcaagcgttaatcggaattactgggcgtaaagcgcacgcaggcggtctgccaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgccctt

SEQ ID NO: 1012 - DNA, 783 bp, Phytoplasma vitis
gtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttccctt

SEQ ID NO: 1013 - DNA, 894 bp, Pantoea agglomerans
ggacaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaacgatgtcgacttggaggttgttcccttgaggagtgcttccggagctacgcgttaagtcgaccgcctggggagtacggccgcaaggttaaactcaaatgaattgacgggggcccgcacaagcggtggagcatgt

SEQ ID NO: 1014 - DNA, 809 bp, Pantoea agglomerans
ggatccacgcattttgattctggctcaggttgaacgctggcggcaggcctaacacatgcaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtgaagcgcacgcaggcggtctgttaagtcagatgtgaaatccccgggcttaacctgggaactgcacttgaaactggcaggcttgagtcttgtagaggggggtagaattccaggtgtagcggtgaaatgcgtagagatctggaggaataccggtggcgaagcggctcctggacaagactgacgctcagtgcgaaagcgtggggagcaaacaggattagatactctggtagtccacgccc

SEQ ID NO: 1015 - DNA, 879 bp, Curtobacterium sp.
ggatccagcactttgatcctggctcaggttgaacgctggcggcaggcctaacacatgcaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaagcggccccctggacaaagactgacgctcaggtgcgaaagcgtggggagcaaacaggattagataccctggtagtccacgccgtaacgatgtcgacttggaggttgttcccttgaggagtggcttccggagctaacggcgttaagtcgacc

SEQ ID NO: 1016 - DNA, 715 bp, Curtobacterium sp.
tgctataatgcagtcgagcgactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaagaacaccagttggcgaagcggcttttttggtctgtaactgacg

SEQ ID NO: 1017 - DNA, 647 bp, Curtobacterium sp.
gtcgagcgactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaacttccacgtgtagcggtgaaatgc

SEQ ID NO: 1018 - DNA, 555 bp, Curtobacterium sp.
ggcggcgtgcctatacatgcaagtcgaacgcttcttttcccaccggagcttgctccaccgggaaaagaggagtggcgaacgggtgagtaacacgtgggtaacctgcccatcagaaggggataacacttggaaacaggtgctaataccgtataacaatcgaaaccgcatggtttcgttttgaaaggcgctttacggtgccgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtttgaccgtgcaactccgcgagagtgaagaaggtttacgtatcgtaaaactctgttgttagagaaaatcaaaggtgagggtaggtatatttcccttgacggtatcttagatcttagctacagctatctactcgtgagggaccgcgtgatcacttttgtgttttgggtctaccccaatcgggggaccactcc

SEQ ID NO: 1019 - DNA, 423 bp, Curtobacterium sp.
ggggaattttccgcaatgggcgaaagcctgatggagcaacgccgcgtgcaggatgaaggctttcgggtcgtaaactgcttttatctgtgacgaatatgacggtagcagatgaataaggatcggctaactccgtgccagcagccgcggtcatacggaggatccaagcgttatccggaattactgggcgtaaagagttgcgtaggtggcattgtaagttggtagtgaaagcgttcggctcaaccgaatatccattaccaaaactgcaaagctagaggatgagagaggttattggaattcctagtgtaggagtgaaatccgtagatattaggaggaacaccgatggcgtaggcagataactggctcattcctgacactaaggcacgaaagcgtgggtagcaaatgggattagataccccagtagtc

SEQ ID NO: 1020 - DNA, 347 bp, Ewingella americana
ctggcttcgggtgttaccgactttcatgacttgacgggcggtgtgtacaaggcccgggaacgtattcaccgcagcgttgctgatctgcgattactagcgactccgacttcatgaggtcgagttgcagacctcaatccgaactgagaccggctttttgggattcgctccaccttacggtatcgcagccctttgtaccggccattgtagcatgcgtgaagcccaagacataaggggcatgatgatttgacgtcatccccaccttcctccgagttgaccccggcagtctcctatgagttcccaccataacgtgctggcaacatagaacgagggttgcgctcgttgcggga

SEQ ID NO: 1021 - DNA, 431 bp, Ewingella americana
  misc_feature 10: N is A,T,C or G
ccttcgacgnctccctccacaagggttgggccaccggcttcaggtgttaccgactttcatgacttgacgggcggtgtgtacaagacccgggaacgtattcaccgcagcgttgctgatctgcgattactagcgactccgacttcatgaggtcgagttgcagacctcaatccgaactgggaccggctttttgggattcgctccacctcgcggtattgcagccctttgtaccggccattgtagcatgcgtgaagcccaagacataaggggcatgatgatttgacgtcatccccaccttcctccgagttgaccccggcagtatcccatgagttcccaccattacgtgctggcaacatagaacgagggttgcgctcgttgcgggacttaacccaacatctcacgacacgagctgacgacaaccatgcaccacctgt

SEQ ID NO: 1022 - DNA, 446 bp, Erwinia persicina
ttaccccaccgacttcgggtgttgtaaactctcgtggtgtgacgggcggtgtgtacaagacccgggaacgtattcaccgcggcatgctgatccgcgattactagcaattccgacttcatgcaggcgagttgcagcctgcaatccgaactgagaccggctttgctgggattggctccacctcgcggcttcgcttcccgttgtaccggccattgtagtacgtgtgtagcccaggtcataaggggcatgatgatttgacgtcatccccaccttcctccggtttgtcaccggcagtcactctagagtgcccagctcaacctgctggcaactaaagtcaagggttgcgctcgttgcgggacttaacccaacatctcacgacacgagctgacgacaaccatgcaccacctgtctcaactttccccgaagggcacctgatgcatctctgcttc

SEQ ID NO: 1023 - DNA, 400 bp, Pantoea agglomerans
acggctccctccacaagggttgggccccggcttcaggtgttaccgactttcatgacttgacgggcggtgtgtacaagacccgggaacgtattcaccgcagcgttgctgatctgcgattactagcgactccgacttcatgaggtcgagttgcagacctcaatccgaactgggaccggctttttgggattcgctccaccttacggtattgcagccctttgtaccggccattgtagcatgcgtgaagcccaagacataaggggcatgatgatttgacgtcatccccaccttcctccgagttgaccccggcagtatcccatgagttcccaccattacgtgctggcaacatagaacgagggttgcgctcgttgcgggacttaacccaacatctcacgacacgagc

SEQ ID NO: 1024 - DNA, 428 bp, Pantoea agglomerans
ttagctgcctcccttgcgggttagcgcactaccttcaggtaaaaccaactcccatggtgtgacgggcggtgtgtacaaggcccgggaacgtattcaccgtggcgtgctgatccacgattactagcgattccaacttcatgggctcgagttgcagagcccaatccgaactgagacggctttttgagatttgcgaagggttgccccttagcgtcccattgtcaccgccattgtagcacgtgtgtagcccagcccgtaagggccatgaggacttgacgtcatccccaccttcctcgcggcttatcaccggcagtctccttagagtgctcaactaaatggtagcaactaaggacgggggttgcgctcgttgcgggacttaacccaacatctcacgacacgagctgacgacagccatgcagcacctgtgctcc

SEQ ID NO: 1025 - DNA, 435 bp, Pantoea ananatis
agctgctttcggttaccgactttaggtacacccggctcccatggcttgacgggcggtgtgtgcaaggtccgggaacgtattcaccgtatcattgctgatatacgattactagcgattccagcttcatggagtcgagttgcagactccaatctgaactgagagcaggtttttgggattggcttcatatcgctatgttgcagccctttgtcctgcccattgtagcacgtgtgtagccctgggcataaaggccatgatgacttgacatcatcccctccttcctcacgccttacggcggcagtttcagtagagttcccagcattacctgttggcaactactgataggggttgcgctcgttgcgggacttaacccaacacctcacggcacgagctgacgacagccatgcagcaccttactatctgtgtattgctacaaaa

SEQ ID NO: 1026 - DNA, 433 bp, Pantoea ananatis
  misc_feature 10: N is A,T,C or G
tagctgcctncttgcggttagcgcactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcacactcgcgtgctcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtctctgcgccaccg

SEQ ID NO: 1027 - DNA, 459 bp, Bacillus sp.
tagctgcctccttgcggttagcacactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcgacatcgctgtctcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtgctccggtccccgaagggaacactacatctctgtagcta

SEQ ID NO: 1028 - DNA, 422 bp, Bacillus sp.
cccttgcggttagactaacggcttctggagcagctcactcccatggtgtgacgggcggtgtgtacaaggcccgggaacgtattcaccgcagcatagctgatctgcgattactagcgattccgacttcatggagtcgagttgcagactccaatccggactgggatcggctttctgggattagctccacctcgcggtcttgcaaccctctgtaccgaccattgtagtacgtgtgtagccctggccgtaagggccatgatgacttgacgtcatccccaccttcctccggtttgtcaccggcagtctccttagagttcccgactttactcgctggcaactaaggacaagggttgcgctcgttgcgggacttaacccaacatctcacgacacgagctgacgacagccatgcagcacctgtgttccga

SEQ ID NO: 1029 - DNA, 476 bp, Enterococcus sp.
  misc_feature 19: N is A,T,C or G
taccgtggttagctgcctncttgcggttagcacactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcgacatcgctgtctcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtgctccggtccccgaagggaacactacatctctgtagctagccgtgct

SEQ ID NO: 1030 - DNA, 452 bp, Enterococcus sp.
tagctgcctccttgcggttagcgcactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcgacatcgctgtctcgctgcccactgtcaccaccattgtagcacgtgtgtagcccagcccgtaagggccatgaggacttgacgtcatccccaccttcctctcggcttatcaccggcagtccccttagagtgcccaactaaatgctggcaactaagggcgagggttgcgctcgttgcgggacttaacccaacatctcacgacacgagctgacgacagccatgcagcacctgtgtcccggtccccgaagggaaccctgcatctct

SEQ ID NO: 1031 - DNA, 475 bp, Unknown
  Uncultured seed derived bacterium of the family Xanthomonadaceae
aagcgccctcccgaaggttaagctacctgcttctggtgcaacaaactcccatggtgtgacgggcggtgtgtacaaggcccgggaacgtattcaccgcagcaatgctgatctgcgattactagcgattccgacttcatggagtcgagttgcagactccaatccggactgagatagggtttctgggattggcttaccgtcgccggcttgcagccctctgtccctaccattgtagtacgtgtgtagccctggccgtaagggccatgatgacttgacgtcatccccaccttcctccggtttgtcaccggcggtctccttagagttcccaccattacgtgctggcaactaaggacaagggttgcgctcgttgcgggacttaacccaacatctcacgacacgagctgacgacagccatgcagcacctgtgttcgagttcccgaaggcaccaatccatctctggaaagttctcgacatgtca

SEQ ID NO: 1032 - DNA, 680 bp, Unknown
  Uncultured seed derived bacterium of the family Enterobacteriaceae
ctacttcttttgcaacccactcccatggtgtgacgggcggtgtgtacaaggcccgggaacgtattcaccgtagcattctgatctacgattactagcgattccgacttcatggagtcgagttgcagactccaatccggactacgacgcactttatgaggtccgcttgctctcgcgaggtcgcttctctttgtatgcgccattgtagcacgtgtgtagccctactcgtaagggccatgatgacttgacgtcatccccaccttcctccagtttatcactggcagtctcctttgagttcccggccgaaccgctggcaacaaaggataagggttgcgctcgttgcgggacttaacccaacatttcacaacacgagctgacgacagccatgcagcacctgtctcagagttcccgaaggcaccaatccatctctggaaagttctctggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgctttcgcacct

SEQ ID NO: 1033 - DNA, 459 bp, Unknown
  Uncultured seed derived bacterium of the family Burkholderiaceae
  misc_feature 21: N is A,T,C or G
gaccgtcctccttgcggttangactaagccacttctggtaaaacccactcccatggtgtgacgggcggtgtgtacaagacccgggaacgtattcaccgcggcatgctgatccgcgattactagcgattccagcttcatgcactcgagttgcagagtgcaatccggactacgatcggttttctgggattagctccccctcgcgggttggcaaccctctgttccgaccattgtatgacgtgtgaagccctacccataagggccatgaggacttgacgtcatccccaccttcctccggtttgtcaccggcagtctccttagagtgctcttgcgtagcaactaaggacaagggttgcgctcgttgcgggacttaacccaacatctcacgacacgagctgacgacagccatgcagcacctgtgcgccggttctctttcgagcactcccacctctcagcaggatt

SEQ ID NO: 1034 - DNA, 407 bp, Unknown
  Uncultured seed derived bacterium of the family Oxalobacteraceae
gagcgccctccttgcggttaggctacccacttctggtaaaacccgctcccatggtgtgacgggcggtgtgtacaagacccgggaacgtattcaccgcgacatgctgatccgcgattactagcgattccaacttcatggagtcgagttgcagactccaatccggactacgatacactttctgggattagctccccctcgcgggttggcggccctctgtatgtaccattgtatgacgtgtgaagccctacccataagggccatgaggacttgacgtcatccccaccttcctccggtttgtcaccggcagtctcattagagtgccctttcgtagcaactaatgacaagggttgcgctcgttgcgggacttaacccaacatctcacgacacgagctgacgacagccatgca

SEQ ID NO: 1035 - DNA, 400 bp, Unknown
  Uncultured seed derived bacterium of the family Enterobacteriaceae
ccaggatcaaactctactacttcttttgcaacccactcccatggtgtgacgggcggtgtgtacaaggcccgggaacgtattcaccgtggcattctgatccacgattactagcgattccgacttcatggagtcgagttgcagactccaatccggactacgacatactttatgaggtccgcttgctctcgcgaggtcgcttctctttgtatatgccattgtagcacgtgtgtagccctggtcgtaagggccatgatgacttgacgtcatccccaccttcctccagtttatcactggcagtctcctttgagttcccggcccggaccgctggcaacaaaggataagggttgcgctcgttgcgggacttaacccaacatttcacaacacgagctgacgacagcca

SEQ ID NO: 1036 - DNA, 408 bp, Unknown
  Uncultured seed derived bacterium of the family Weeksellaceae
taggcagctcctgttacggtcaccgacttcaggtaccccagacttccatggcttgacgggcggtgtgtacaaggcccgggaacgtattcaccgcgccatggctgatgcgcgattactagcgattccagcttcatagagtcgagttgcagactccaatccgaactgagaccggctttcgagatttgcatcacatcgctgtgtagctgccctctgtaccggccattgtattacgtgtgtggcccaaggcgtaagggccgtgatgatttgacgtcatccccaccttcctctctacttgcgtaggcagtctcactagagtccccaactgaatgatggcaactagtgacaggggttgcgctcgttgcaggacttaacctaacacctcacggcacgagctgacgacaaccatgc

SEQ ID NO: 1037 - DNA, 418 bp, Unknown
  Uncultured seed derived bacterium of the family Sphingomonadaceae
ctctcttgcgagttagcgcaacgccttcgggtgaatccaactcccatggtgtgacgggcggtgtgtacaaggcctgggaacgtattcaccgcggcatgctgatccgcgattactagcgattccgccttcatgcactcgagttgcagagtacaatccgaactgagacaacttttggagattagctcaccctcgcgggattgctgcccactgtagttgccattgtagcacgtgtgtagcccagcgcgtaagggccatgaggacttgacgtcatccccaccttcctccggcttatcaccggcggttcctttagagtacccaactaaatgatggtaactaaaggcgagggttgcgctcgttgcgggacttaacccaacatctcacgacacgagctgacgacagccatgcagcacctgtgtgt

SEQ ID NO: 1038 - DNA, 473 bp, Unknown
  Uncultured seed derived bacterium of the family Micrococcaceae
ccttcgacggctccctccacaagggttgggccaccggcttcgggtgttaccgactttcgtgacttgacgggcggtgtgtacaaggcccgggaacgtattcaccgcagcgttgctgatctgcgattactagcgactccgacttcatgaggtcgagttgcagacctcaatccgaactgagaccggctttttgggattagctccacctcacagtatcgcaaccctttgtaccggccattgtagcatgcgtgaagcccaagacataaggggcatgatgatttgacgtcatccccaccttcctccgagttgaccccggcagtctcccatgagtccccaccatcacgtgctggcaacatggaacgagggttgcgctcgttgcgggacttaacccaacatctcacgacacgagctgacgacaaccatgcaccacctgtataccgaccccaaaggggaagaaccatctctggaacgccgct

SEQ ID NO: 1039 - DNA, 428 bp, Unknown
  Uncultured seed derived bacterium of the family Burkholderiaceae
ggtgaccgtcctccttgcggttagactagccacttctggtaaaacccactcccatggtgtgacgggcggtgtgtacaagacccgggaacgtattcaccgcggcatgctgatccgcgattactagcgattccagcttcatgcactcgagttgcagagtgcaatccggactacgatcggttttctgggattagctccccctcgcgggttggcaaccctctgttccgaccattgtatgacgtgtgaagccctacccataagggccatgaggacttgacgtcatccccaccttcctccggtttgtcaccggcagtctccttagagtgctcttgcgtagcaactaaggacaagggttgcgctcgttgcgggacttaacccaacatctcacgacacgagctgacgacagccatgcagcacctgtgcgccggttc

SEQ ID NO: 1040 - DNA, 443 bp, Unknown
  Uncultured seed derived bacterium of the family Microbacteriaceae
cttcgacggctccctccacaagggttaggccaccggcttcaggtgttaccgactttcatgacttgacgggcggtgtgtacaagacccgggaacgtattcaccgcagcgttgctgatctgcgattactagcgactccgacttcatgaggtcgagttgcagacctcaatccgaactgggaccggctttttgggattcgctccacctcacggtattgcagccctttgtaccggccattgtagcatgcgtgaagcccaagacataaggggcatgatgatttgacgtcatccccaccttcctccgagttgaccccggcagtatcccatgagttcccaccattacgtgctggcaacatagaacgagggttgcgctcgttgcgggacttaacccaacatctcacgacacgagctgacgacaaccatgcaccacctgtatacgagtgtcca

SEQ ID NO: 1041 - DNA, 463 bp, Unknown
  Uncultured seed derived bacterium of the family Sphingobacteriaceae
accctaggacgctccttgcggctacgtactttaggtacccccagcttccatggcttgacgggcggtgtgtacaaggcccgggaacgtattcaccgcgtcattgctgatacgcgattactagcgaatccaacttcaagaggtcgagttgcagacctctatccgaactgtgatcggctttttgagattggcattccattgctggatagctgccctctgtaccgaccattgtagcacgtgtgtagccccggacgtaagggccatgatgacttgacgtcgtcccctccttcctctctgtttgcacaggcagtctgtctagagtccccaccattacatgctggcaactagacataggggttgcgctcgttgcgggacttaacccaacacctcacggcacgagctgacgacagccatgcagcacctagtttcgtgtgattgctcactgtcccatctctggaacattcac

SEQ ID NO: 1042 - DNA, 466 bp, Unknown
  Uncultured seed derived bacterium of the family Pseudomonadaceae
acaccgcggtaaccgtccccccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttatgggattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccattacgtgctggtaactaaggacaagggttgcgctcgttacgggacttaacccaacatctcacgacacgagctgacgacagccatgcagcacctgtctcaatgttcccgaaggcaccaatccatctctgg

SEQ ID NO: 1043 - DNA, 430 bp, Unknown
  Uncultured seed derived bacterium of the family Oxalobacteraceae
  misc_feature 20, 24: N is A,T,C or G
gtaagcgccctccttgcggntaanctacctacttctggtaaaacccgctcccatggtgtgacgggcggtgtgtacaagacccgggaacgtattcaccgcgacatgctgatccgcgattactagcgattccaacttcatgcagtcgagttgcagactacaatccggactacgatacactttctgggattagctccccctcgcgggttggcggccctctgtatgtaccattgtatgacgtgtgaagccctacccataagggccatgaggacttgacgtcatccccaccttcctccggtttgtcaccggcagtctcattagagtgctctttcgtagcaactaatgacaagggttgcgctcgttgcgggacttaacccaacatctcacgacacgagctgacgacagccatgcagcacctgtgtgcaggttctct

SEQ ID NO: 1044 - DNA, 426 bp, Unknown
  Uncultured seed derived bacterium of the family Micromonosporaceae
cggctccctccacaagggttgggccaccggcttcgggtgttgccgactttcgtgacgtgacgggcggtgtgtacaaggcccgggaacgtattcaccgcagcgttgctgatctgcgattactagcgactccgacttcacggggtcgagttgcagaccccgatccgaactgagaccggctttttgggattcgctccacctcacggcatcgcaacccattgtaccggccattgtagcatgcgtgaagccctggacataaggggcatgatgacttgacgtcatccccaccttcctccgagttgaccccggcagtcttcgatgagtccccgccataacgcgctggcaacatcgaacgagggttgcgctcgttgcgggacttaacccaacatctcacgacacgagctgacgacagccatgcaccacctgtga

SEQ ID NO: 1045 - DNA, 438 bp, Unknown
  Uncultured seed derived bacterium of the family Microbacteriaceae
cttcgacggctccctccacaagggttgggccaccggcttcgggtgttaccgactttcatgacttgacgggcggtgtgtacaaggcccgggaacgtattcaccgcagcgttgctgatctgcgattactagcgactccgacttcatgaggtcgagttgcagacctcaatccgaactgagaccggctttttgggattcgctccaccttacggtattgcagccctttgtaccggccattgtagcatgcgtgaagcccaagacataaggggcatgatgatttgacgtcatccccaccttcctccgagttgaccccggcagtctcctatgagttcccgccataacgcgctggcaacatagaacgagggttgcgctcgttgcgggacttaacccaacatctcacgacacgagctgacgacaaccatgcaccacctgtatacgagt

SEQ ID NO: 1046 - DNA, 447 bp, Unknown
  Uncultured seed derived bacterium of the family Burkholderiaceae
ctaccgtggtgaccgtcctccttgcggttagactagccacttctggtaaaacccactcccatggtgtgacgggcggtgtgtacaagacccgggaacgtattcaccgcggcatgctgatccgcgattactagcgattccagcttcacgcagtcgagttgcagactgcgatccggactacgatcggttttctgggattggctccacctcgcggcttggcaaccctctgttccgaccattgtatgacgtgtgaagccctacccataagggccatgaggacttgacgtcatccccaccttcctccggtttgtcaccggcagtctccctagagtgctcttgcgtagcaactagggacaagggttgcgctcgttgcgggacttaacccaacatctcacgacacgagctgacgacagccatgcagcacctgtgttacggctccctttcgggcac

SEQ ID NO: 1047 - DNA, 418 bp, Unknown
  Uncultured seed derived bacterium of the family
  misc_feature 22, 28, 173, 206: N is A,T,C or G
aaccctgcctccttgcggttangctcangcgcttctggagcaaacgactcccatggtgtgacgggcggtgtgtacaaggcccgggaacgtattcaccgctgcctgctgatcagcgattactagcgattccgacttcaaagagtcgagttgcagactcttatctgtactgaggncgggtttttgcgattggcttcccctcgcggggncgcatcgctttggccgaccattgtagcacgtgtgtagccctggacataagggccatgatgacttgacgtcatccccaccttcctccgatttgaatatcggcggtctcactagagttcccggcatgacccgatggcaactagtgataggggttgcgctcgttgcgggacttaacccaacatctcacgacacgagctgacgacagccatgcagc

SEQ ID NO: 1048 - DNA, 468 bp, Unknown
  Uncultured seed derived bacterium of the family
  misc_feature 117, 130, 150, 312, 345, 372, 389, 464: N is A,T,C or G
tgcctccttgcggttagcgcgacgccttcgggtaaacccaactcccatggtgtgacgggcggtgtgtacaaggcccgggaatgtattcaccgtggcatgctgatccacgattactancgattccaccttnatgcactctagttgcagagngcaatctgaactgagacggctttttgggattagctcgaggtcgccctttcgctgcccattgtcaccgccattgtagcacgtgtgtagcccagcctgtaagggccatgaggacttgacgtcatccccaccttcctcgcggcttatcaccggcagtccccctanagttcccaacttaatgatggcaactatagggcnagggttgcgctctttgcgggacttaanccaacattttcgaacanagctgacgacagccatgcagcacctgtgttccggccagccgaactgaagaaaggcatctttgccgatcaaacctnacgt

SEQ ID NO: 1049 - DNA, 389 bp, Unknown
  Uncultured seed derived bacterium of the family Caulobacteraceae
taccgtggtcgcctgcctccttgcggttaagcgcagcgccttcgggtagaaccaactcccatggtgtgacgggcggtgtgtacaaggcccgggaacgtattcaccgcggcatgctgatccgcgattactagcgattccaacttcatgccctcgagttgcagaggacaatccgaactgagacgacttttagggatttgccctctgtagtcgccattgtagcacgtgtgtagcccaccctgtaagggccatgaggacttgacgtcatccccaccttcctccggcttagcaccggcagtcctgttagagttcccaactaaatgatggcaactaacagcgagggttgcgctcgttgcgggacttaacccaacatctcacgacacgagctgacg

SEQ ID NO: 1050 - DNA, 458 bp, Unknown
  Uncultured seed derived bacterium of the family Oxalobacteraceae
cgtggtaatcgccctccttgcggttaggctaactacttctggtaaagcccactcccatggtgtgacgggcggtgtgtacaagacccgggaacgtattcaccgcggcatgctgatccgcgattactagcgattccagcttcacgtagtcgaattgcagactacgatccggactacgatgcattttctgggattagctccacctcgcggcttggcaaccctctgtatgcaccgttgtatgacgtgtgaagccctacccataagggccatgaggacttgacgtcatccccaccttcctccggtttgtcaccggcagtctctctagagtgccctttcgtagcaactagagacaagggttgcgctcgttgcgggacttaacccaacatctcacgacacgagctgacgacagccatgcagcacctgtgtccactttctctttcgagcacctaatgcatctctgc

SEQ ID NO: 1051 - DNA, 429 bp, Unknown
  Uncultured seed derived bacterium of the family Burkholderiaceae
ctaccgtggtgaccgtcctccttgcggttagactagccacttctggtaaaacccactcccatggtgtgacgggcggtgtgtacaagacccgggaacgtattcaccgcggcatgctgatccgcgattaccagcgattccagcttcacgcagtcgagttgcagaccgcgatccggactacgatcggttttctgggattggctccacctcgcggcttggcaaccctctgttccgaccattgtatgacgtgtgaagccctacccataagggccatgtggacttgacgtcatccccaccttcctccggtttgtcaccggcagtctccctagagtgctcttgcgtagcaactagggacaagggttgcgctcgttgcgggacttaacccaacatctcacgacacgagctgacgacagccatgcagcacctgtgtta

SEQ ID NO: 1052 - DNA, 498 bp, Unknown
  Uncultured seed derived bacterium of the family Rhizobiaceae
cggtcgcctgcctcccttgcgggttagcgcagcgccttcgggtaaaaccaactcccatggtgtgacgggcggtgcgtacaaggcccgggaacgtattcaccgtggcatgctgatccacgattactagcgattccaacttcatgcactcgagttgcagagtgcaatccgaactgagacggctttttgggattagcttctcctcgcgaagtagctgcccactgtcaccgccattgtagcacgtgtgtagcccagcccgtaagggccatgaggacttgacgtcatccccaccttcctctcggcttatcaccggcagtccctctagagtgcccaacttaatgatggcaactagaggcgagggttgcgctcgttgcgggacttaacccaacatctcacgacacgagctgacgacagccatgcagcacctgtgttcacgccagccgaactgaagaaatccgtctccggaattcatacgtgacatgtcaagagctggtaaggttc

SEQ ID NO: 1053 - DNA, 439 bp, Unknown
  Uncultured seed derived bacterium of the family Burkholderiaceae
atcccaccgtggtaagcgccctccttgcggttaggctacctacttctggtgaaacccactcccatggtgtgacgggcggtgtgtacaagacccgggaacgtattcaccgcggcatgctgatccgcgattactagcgattccagcttcacgcactcgagttgcagagtgcgatccggactacgatcggttttctgggattggctccccctcgcgggttggcgaccctctgttccgaccattgtatgacgtgtgaagccctacccataagggccatgaggacttgacgtcatccccaccttcctccggtttgtcaccggcagtctccctggagtgctcttgcgtagcaactagggacaagggttgcgctcgttgcgggacttaacccaacatctcacgacacgagctgacgacagccatgcagcacctgtgttatggctcc

SEQ ID NO: 1054 - DNA, 429 bp, Unknown
  Uncultured seed derived bacterium of the family Rhodospirillaceae
ctaccgtggtcggctgcctccttgcggttagcgcaccggcttcgggtagaaccaactcccatggtgtgacgggcggtgtgtacaaggcccgggaacgtattcaccgcgccatgctgatgcgcgattactagcgattccaacttcatgtactcgagttgcagagtacaatccgaactgagatggctttttgagattagcttggcgtcaccgcctcgcgacccattgtcaccaccattgtagcacgtgtgtagcccaacccgtaagggccatgaggacttgacgtcatccccgccttcctccggcttgtcaccggcagtttctccagagtgcccaactaaatgatggcaactgaagatgggggttgcgctcgttgcgggacttaacccaacatctcacgacacgagctgacgacagccatgcagcacctgt

SEQ ID NO: 1055 - DNA, 406 bp, Unknown
  Uncultured seed derived bacterium of the family Burkholderiaceae
ctaccgtggggaccgtcttccttgcggttaaactagccacttctggtaaaacccactcccatggtgtgacgggcggtgtgtacaagacccgggaacgtattcaccgcggcatgctgttccgcgattactagcgattccagcttcatgcagtcgagttgcagactgcaatccggactacgatcggctttctgggattggctcaccttcgcagggtcgctgccctctggaccgaccattgtatgacgtgtgaagccctacccgtaagggccatgaggacttgacgtcatccccaccttcctccggcttgtcaccggcagtctccttagagtgccctcgcgtagcaaataaggataagggttgcgctcgttgcgggacttaacccaacatctcacgacacgagctgacg

SEQ ID NO: 1056 - DNA, 419 bp, Unknown
  Uncultured seed derived bacterium of the family
cttcggcagctccctccttgcggttgggtcactgacttcgggcatattagactcccatggtgtgacgggcggtgtgtacaagacccgggaacgtattcaccacgacattctgattcgcgattactagcgattccagcttcatgtagtcgagttgcagactacaatccgaactgagatgacctttttgagatttgctccacttcgcagtcttgcttctctttgtagtcaccattgtagcacgtgtgtagcccagatcataaggggcatgatgatttgacgtcatccccaccttcctccaggttatccctggcagtctctctagagtgcccatccaaaatgctggctactaaagataggggttgcgctcgttgcgggacttaacccaacatctcacgacacgagctgacgacaaccatgca

SEQ ID NO: 1057 - DNA, 448 bp, Unknown
  Uncultured seed derived bacterium of the family Rhizobiaceae
taccgtggttagctgcctccttgcggttagcgcactaccttcgggtaaaaccaactcccatggtgtgacgggcggtgtgtacaaggcccgggaatgtattcaccgcggcatgctgatccgcgattactagcgattccaacttcatgcactcgagttgcagagtgcaatccgaactgagatggcttttggagattagctcacactcgcgtgctcgctgcccactgtcaccaccattgtagcacgtgtgtagctcagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtctctgcgccaccgaagtgg

SEQ ID NO: 1058 - DNA, 439 bp, Unknown
  Uncultured seed derived bacterium of the family Xanthomonadaceae
  misc_feature 4: N is A,T,C or G
tccnggtcgtcgtcccccttgcggttagactaacggcttctggagcagctcactcccatggtgtgacgggcggtgtgtacaaggcccgggaacgtattcaccgcagcatagctgatctgcgattactagcgattccgacttcatggagtcgagttgcagactccaatccggactgggatcggctttctgggattagctccacctcgcggtcttgcaaccctctgtaccgaccattgtagtacgtgtgtagccctggccgtaagggccatgatgacttgacgtcatccccaccttcctccggtttgtcaccggcagtctccttagagttcccgactttactcgctggcaactaaggacaagggttgcgctcgttgcgggacttaacccaacatctcacgacacgagctgacgacagccatgcagcacctgtgttccgatt

SEQ ID NO: 1059 - DNA, 426 bp, Unknown
  Uncultured seed derived bacterium of the family Xanthomonadaceae
caccgtggctagcgccctcccgaaggttaagctacctgcttctggtgcaacaaactcccatggtgtgacgggcggtgtgtacaaggcccgggaacgtattcaccgcagcaatgctgatctgcgattactagcgattccgacttcatggagtcgagttgcagactccaatccggactgagatagggtttctgggattggctcaccctcgcgggtttgcagccctctgtccctaccattgtagtacgtgtgtagccctggtcgtaagggccatgatgacttgacgtcatccccaccttcctccggtttgtcaccggcggtctccttagagttcccaccattacgtgctggcaactaaggacaagggttgcgctcgttgcgggacttaacccaacatctcacgacacgagctgacgacagccatgcagc

SEQ ID NO: 1060 - DNA, 433 bp, Unknown
  Uncultured seed derived bacterium of the family Burkholderiaceae
aatcctaccgtggggaccgtcttccttgcggttaaactagccacttctggtaaaacccactcccatggtgtgacgggcggtgtgtacaagacccgggaacgtattcaccgcggcatgctgttccgcgattactagcgattccagcttcatgcagtcgagttgcagactgcaatccggactacgatcggctttctgggattggctcaccttcgcagggtcgctgccctctggaccgaccattgtatgacgtgtgaagccctacccgtaagggccatgaggacttgacgtcatccccaccttcctccggcttgtcaccggcagtctccttagagtgccctcgcgtagcaaataaggataagggttgcgctcgttgcgggacttaacccaacatctcacgacacgagctgacgacagccatgcagcacctgtgtgt

SEQ ID NO: 1061 - DNA, 434 bp, Unknown
  Uncultured seed derived bacterium of the family Bacillaceae
ccttaggcggctagctccttacggttactccaccgacttcgggtgttacaaactctcgtggtgtgacgggcggtgtgtacaaggcccgggaacgtattcaccgcggcatgctgatccgcgattactagcgattccagcttcatgtaggcgagttgcagcctacaatccgaactgagaatggttttatgggattggcttgacctcgtggtcttgcagccctttgtaccatccattgtagcacgtgtgtagcccaggtcataaggggcatgatgatttgacgtcatccccaccttcctccggtttgtcaccggcagtcaccttagagtgcccaactaaatgctggcaactaagatcaagggttgcgctcgttgcggacttaacccaacatctcacgacacgagctgacgacaaccatgcaccacctgtcactctgt

SEQ ID NO: 1062 - DNA, 431 bp, Unknown
  Uncultured seed derived bacterium of the family Coxiellaceae
acagcgacctccttacggttagtcgactggcgtctggtaaaacccactcccatggtgtgacgggcggtgtgtacaaggcccgagaacgtattcaccgcaacgtgctgatttgcgattactagcgattccagcttcatggagtcgagttgcagactccaatccggactacgagatattttgaagattagctccccctcgcgggttggcgactcattgtataccccattgtagcacgtgtgttgccctacccataaaggccatgatgacttgacatcatcctccccttcctccagcttatcactggcagtctccctcgagtactcaagcttacctgtagcaacaagggataagggttgcgctcgttacgggacttaacccaacatctcacgacacgagctgacgacagccatgcagcacctgtctctgagctc

SEQ ID NO: 1063 - DNA, 419 bp, Unknown
  Uncultured seed derived bacterium of the family Bradyrhizobiaceae
ctaccgtggccggctgcctccttgcggttagcgcaccgtcttcaggtaaaaccaactcccatggtgtgacgggcggtgtgtacaaggcccgggaacgtattcaccgtggcgtgctgatccacgattactagcgattccaacttcatgggctcgagttgcagagcccaatccgaactgagacggctctttgagatttgcgaagggtcgccccttagcatcccattgtcaccgccattgtagcacgtgtgtagcccagcccgtaagggccatgaggacttgacgtcatccccaccttcctcgcggcttatcaccggcagtctccttagagtgctcaactaaatggtagcaactaaggacgggggttgcgctcgttgcgggacttaacccaacatctcacgacacgagctgacgacagccat

SEQ ID NO: 1064 - DNA, 399 bp, Unknown
  Uncultured seed derived bacterium of the family Paenibacillaceae
ccttcggcggctggccccttgcggttaccccaccgacttcgggtgttgtaaactctcgtggtgtgacgggcggtgtgtacaagacccgggaacgtattcaccgcggcatgctgatccgcgattactagcaattccgacttcatgcaggcgagttgcagcctgcaatccgaactgagaccggcttctaaggattggctccacctcgcggcttcgcttcccgttgtaccggccattgtagtacgtgtgtagcccaggtcataaggggcatgatgatttgacgtcatccccgccttcctccggtttgtcaccggcagtcactctagagtgcccaactcaatgctggcaactaaagtcaagggttgcgctcgttgcgggacttaacccaacatctcacgacac

SEQ ID NO: 1065 - DNA, 439 bp, Unknown
  Uncultured seed derived bacterium of the family Chitinophagaceae
ccctaggcggctccttgcggttaccgactttaggtacacccagcttccatggcttgacgggcggtgtgtgcaaggtccgggaacgtattcaccgtatcattgctgatatacgattactagcgattccagcttcacgcagtcgagttgcagactgcgatctgaactgagaaagggtttttgagattagcgccttgtcaccaagtggcagctcgttgtcccttccattgtagcacgtgtgtagccctgggcataaaggccatgatgacttgacatcatcccctccttcctcgcgtcttacgacggcagtttcattagagttcccagctttacctgatggcaactaatgatgggggttgcgctcgttgcgggacttaacccaacacctcacggcacgagctgacgacagccatgcagcaccttacagactgtgtattgctac

SEQ ID NO: 1066 - DNA, 429 bp, Unknown
  Uncultured seed derived bacterium of the family Planococcaceae
ccttcggcggctggctcccgtaagggttaccccaccgacttcgggtgttacaaactctcgtggtgtgacgggcggtgtgtacaagacacgggaacgtattcaccgtggcatgctgatccacgattactagcgattccggcttcatgcaggcgagttgcagcctacaatccgaactgggaacggttttatgggattggctccccctcgcgggttggctaccctctgtaccgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgt

SEQ ID NO: 1067 - DNA, 399 bp, Unknown
  Uncultured seed derived bacterium of the family Streptomycetaceae
accttcgacagctccctccacaaggggttgggccaccggcttcgggtgttaccgactttcgtgacgtgacgggcggtgtgtacaaggcccgggaacgtattcaccgcagcaatgctgatctgcgattactagcaactccgacttcatggggtcgagttgcagaccccaatccgaactgagacaggctttttgagattcgctccacctcacggtatcgcagctcattgtacctgccattgtagcacgtgtgcagcccaagacataaggggcatgatgacttgacgtcgtccccaccttcctccgagttgaccccggcggtctcctgtgagtccccgtcaccccgaagggcacgctggcaacacaggacaagggttgcgctcgttgcgggacttaacccaa

SEQ ID NO: 1068 - DNA, 373 bp, Unknown
  Uncultured seed derived bacterium of the family Comamonadaceae
ctgccgtggtaatcgccctccttgcggttaggctaactacttctggcagaacccgctcccatggtgtgacgggcggtgtgtacaagacccgggaacgtattcaccgcgacattctgatccgcgattactagcgattccgacttcacgtagtcgagttgcagactacgatccggactacgactggttttatgggattagctccccctcgcgggttggcaaccctctgtaccagccattgtatgacgtgtgtagccctacctataagggccatgaggacttgacgtcatccccaccttcctccggttcgtcaccggcagtctcattagagtgcccaactaaatgtagcaactaatgacaagggttgcgctcgttg

SEQ ID NO: 1069 - DNA, 439 bp, Unknown
  Uncultured seed derived bacterium of the family Sinobacteraceae
gccgtggtaggcgccccccttgcggtcaggctacctgcttctggtgcaatcaactcccatggtgtgacgggcggtgtgtacaagacccgggaacgtattcaccgcagcaatgctgatctgcgattactagcgattccgacttcacggagtcgagttgcagactccgatccggactacgataagttttctgggattggctccgtctcgcgacttggcttccctctgtacttaccattgtagcacgtgtgtagccctggccataaaggccatgatgacttgacgtcatccccaccttcctccggtttgtcaccggcggtctccttagagtgcccaacttaatgctggcaactaaggacaagggttgcgctcgttgcgggacttaacccaacatctcacgacacgagctgacgacagccatgcagcacctgtgttcgagttc

SEQ ID NO: 1070 - DNA, 734 bp, Unknown
  Uncultured seed derived bacterium of the family
aacaggattagataccctggtagtccacgccgtaaacgatgagtgctagatgtccggggtatcgacccccctggtgtcgcagctaacgcaataagcactccgcctggggagtacggccgcaaggttgaaactcaaaggaattgacgggggcccgcacaagtggtggagcatgtgcattaattcgtcactaaccgaagaaccttaccagggtttgacatcctctgacatcctgtgaaagcaggctttcctcgcaagaggacagagagacaggtgttgcatggttgtcgtcagctcgtgtcgtgagatgttgggttaagtcccgcaacgagcgcaaccctcacccaatgttgccagcgtcaagtcgggcactctttgggaactgcccgtgtaagcgggaggaaggtggggatgacgtcaaatcggcatggcccttacatcctgggcttgacacatgctacaatggccgttaaacagagcgacgcaataccgcgaggtggagccaatcgcaaaaatacggtctcagttcggattgcaggctgcaactcgcctgcatgaagtcggaatcgctagtaaccgcaggtcagctaaactgcggtgaatacgttcccgggccttgtacacactgcccgtcaagtcacctgagttgtctgcagccgaagccagtggcctaaccgcaagggaggagctgtctaagctgtggggagcgagggggactaagtcgtaacaaggtaacc

SEQ ID NO: 1071 - DNA, 436 bp, Unknown
  Uncultured seed derived bacterium of the family Cytophagaceae
taccgtggggaccgtcttccttgcggttaaactagccacttctggtaaaacccactcccatggcctgacgggcggtgtgtacaaggtccgggaacgtattcaccgcgccattgctgatgcgcgattactagcgattccaacttcatgcaggcgagttgcagcctgcaatccgaactgagacgtactttttgtgattggctcaccatcgctggcttgcaacactttgtatacgccattgtagcacgtgtgtagccctggacgtaagggccatgatgacctgacgtcatcccctccttcctctccgcttgcgcgggcagtttttctagagtccccatcattacatgccggcaactagaaacaggggttgcgctcgttgcgggacttaacccaacacctcacggcacgagctgacgacggccatgcagcaccttgctcc

SEQ ID NO: 1072 - DNA, 306 bp, Unknown
  Uncultured seed derived bacterium of the family Burkholderiaceae
  misc_feature 205: N is A,T,C or G
tggggaccgtcttccttgcggttaaactagccacttctggtaaaacccactcccatggtgtgacgggcggtgtgtacaagacccgggaacgtattcaccgcggcatgctgttccgcgattactagcgattccagcttcgtgcagtcgagttgcagactgcaatccggactacgatcggctttctgggattggctcaccttcgcanggtcgctgccctctggaccgaccattgtatgacgtgtgaagccctacccgtaagggccatgaggacttgacgtcatccccaccttcctccggcttgtcacc

SEQ ID NO: 1073 - DNA, 449 bp, Unknown
  Uncultured seed derived bacterium of the family Bradyrhizobiaceae
taccgtggccggctgcctccattgctggttagcgcaccgtcttcaggtaaaaccaactcccatggtgtgacgggcggtgtgtacaaggcccgggaacgtattcaccgtggcgtgctgatccacgattactagcgattccaacttcatgggctcgagttgcagagcccaatccgaactgagacggctttttgagatttgctaggacttgcgtcttcgcatcccattgtcaccgccattgtagcacgtgtgtagcccagcccgtaagggccatgaggacttgacgtcatccccaccttcctcgcggcttatcaccggcagtctccttagagtgctcaactaaatggtagcaactaaggacgggggctgcgctcgttgcgggacttaacccaacatctcacgacacgagctgacgacagccatgcagcacctgtgttccaggctccgaagag

SEQ ID NO: 1074 - DNA, 317 bp, Unknown
  Uncultured seed derived bacterium of the family Bacillaceae
ccaccttaggcggctggctccaaaaaggttaccccaccgacttcgggtgttacaaactctcgtggtgtgacgggcggtgtgtacaaggcccgggaacgtattcaccgcggcatgctgatccgcgattactagcgattccagcttcatgtaggcgagttgcagcctacaatccgaactgagaacggttttatgagattagctccacctcgcggtcttgcagctctttgtaccgtccattgtagcacgtgtgtagcccaggtcataaggggcatgatgatttgacgtcatccccaccttcctccggtttgtcaccggca

SEQ ID NO: 1075 - DNA, 656 bp, Unknown
  Uncultured seed derived bacterium of the family Anaeroplasmataceae
aatcctaccctagtcaactacttcccttgcgggttagttaagttagttttaggcattactgactttcgtgatttgacgggcggtgtgtacaagacccgagaacgtattcaccgtgacactgctgattcacgattactagcaattccgacttcatggagtcgagttgcagactccaatccgaacttgggttagttttttgggattagctccccctcgcgggttggcgaccctttgtcctaaccattgtagcacgtgtgtagcccaaggcataagggccatgacgaccagacgtcatcctctccttcctccaagttgccttggcagtctacctagagttctcaccttaaatgtagtaactaagtatgagggttgcgttcgttctagcacttaagagtacacttcacagcacgaactgacgacggccatgcagcacctgtgtttggataacctctgctcggtttcccgagtcttgccaaacatgtcaagccttggtaaggttttacgcgttgtatcggattaaaccacatgctccagtgcttgtgcgggtccccgtcaattcctttgagtttcagcctcgcggccgtactacccaggcggagcatttaaagcgttaactgcgacactgagccaacgcccaatgtctaatgctcatcgtt

SEQ ID NO: 1076 - DNA, 534 bp, Unknown
  Uncultured seed derived bacterium of the family Sphingomonadaceae
accaccgtggtcgcctgcctcccttacgggttagcgcaacgccttcgggtgaatccaactcccatggtgtgacgggcggtgtgtacaaggcctgggaacgtattcaccgcggcatgctgatccgcgattactagcgattccgccttcatgctctcgagttgcagagaacaatccgaactgagacggcttttgggattagcatcctctcgcgaggtagcaacccgttgtcaccgccattgtagcacgtgtgtagcccagcgtgtaagggccatgaggacttgacgtcatccccaccttcctccggcttatcaccggcggtttctttagagtgcccaactaaatgatggcaactaaagacgagggttgcgctcgttgcgggacttaacccaacatctcacgacacgagctgacgacagccatgcagcacctgtcactcatccagccgaactgaaggaaatcatctctgaaatccgcgatgaggatgtcaaacgctggtaaggttctgcgcgttgcttcgaattaaaccacatgctc

SEQ ID NO: 1077 - DNA, 374 bp, Unknown
  Uncultured seed derived bacterium of the family Pseudonocardiaceae
  misc_feature 10: N is A,T,C or G
accttcgacnctccctccccttacggggttgggccatgggcttcgggtgttaccgactttcatgacgtgacgggcggtgtgtacaaggcccgggaacgtattcaccgcagcgttgctgatctgcgattactagcgactccgacttcacgcagtcgagttgcagactgcgatccgaactgagaccggctttaagggattcgctccacctcgcggtatcgcagccctctgtaccagccattgtagcatgtgtgaagccctggacataaggggcatgatgacttgacgtcatccccaccttcctccgagttgaccccggcagtctcccacgagtccccgcataacgcgctggcaacgtaggataagggttgcgctcg

SEQ ID NO: 1078 - DNA, 429 bp, Unknown
  Uncultured seed derived bacterium of the family Brucellaceae
ccctaccgtggctagctgcctccttgcggttagcgcactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctccacatcgctgtctcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggctgcgctcgttgcgggacttaacccaacatctcacgacacgagctgacgacagccatgcagcacc

SEQ ID NO: 1079 - DNA, 419 bp, Unknown
  Uncultured seed derived bacterium of the family Phyllobacteriaceae
tgaccctaccgtggtcgcctgcctccttgcggttagcacagcgccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcgacctcgcggtctcgctgcccactgtcaccaccattgtagcacgtgtgtagcccagcccgtaagggccatgaggacttgacgtcatccccaccttcctctcggcttatcaccggcagtccccttagagtgcccaacttaatgctggcaactaagggcgagggttgcgctcgttgcgggacttaacccaacatctcacgacacgagctgacgaca

SEQ ID NO: 1080 - DNA, 369 bp, Unknown
  Uncultured seed derived bacterium of the family Burkholderiaceae
atcctaccgtggtgaccgtcctccttgcggttagactagccacttctggtaaaacccactcccatggtgtgacgggcggtgtgtacaagacccgggaacgtattcaccgcggcatgctgatccgcgattactagcgattccagcttcacgcagtcgagttgcagactgcgatccggactacgatcggttttctgggattggctccacctcgcggcttggcaaccctctgttccgaccattgtatgacgtgtgaagccctacccataagggccatgaggacttgacgtcatccccaccttcctccggtttgtcaccggcagtccccctagagtgctcttgcgtagcaactagggacaagggttgcgctcg

SEQ ID NO: 1081 - DNA, 422 bp, Unknown
  Uncultured seed derived bacterium of the family Rhodospirillaceae
cctaccgtggtcggctgcttccttgcggttagcgcaccggcttcgggtagaaccaactcccatggtgtgacgggcggtgtgtacaaggcccgggaacgtattcaccgcggcatgctgatccgcgattactagcgattccaacttcatgcacccgagttgcagagtgcaatccgaactgagacggctttttgagatcggctcaggctcgcgcctttgctccccattgtcaccgccattgtagcacgtgtgtagcccaacccgtaagggccatgaggacttgacgtcatccccgccttcctccggcttgtcaccggcagtttcttcagagtgcccaactaaatgatggcaactgaagatgagggttgcgctcgttgcgggacttaacccaacatctcacgacacgagctgacgacagccatgca

SEQ ID NO: 1082 - DNA, 432 bp, Unknown
  Uncultured seed derived bacterium of the family Sinobacteraceae
  misc_feature 307: N is A,T,C or G
accgtggtaagcgccctccttgcggtcaggctacctgcttctggtgcaatcaactcccatggtgtgacgggcggtgtgtacaagacccgggaacgtattcaccgcagcaatgctgatccgcgattactagcgattccaacttcatggagtcgagttgcagactccaatccggactaagacaagttttctgggattagctccccgtcgccggttggcttccctctgtacttgccattgtagcacgtgtgtagccctggccataaaggccatgatgacttgacgtcatccccaccttcctccggtttgncaccggcggtctccttagagttcccaactgaatgatggcaactaaggacaagggttgcgctcgttgcgggacttaacccaacatctcacgacacgagctgacgacagccatgcagcacctgtgtt

SEQ ID NO: 1083 - DNA, 459 bp, Unknown
  Uncultured seed derived bacterium of the family Enterobacteriaceae
ggtaagcgccctcccgaaggttaagctacctacttcttttgcaacccactcccatggtgtgacgggcggtgtgtacaaggcccgggaacgtattcaccgtagcattctgatctacgattactagcgattccgacttcacggagtcgagttgcagactccgatccggactacgacgcactttatgaggtccgcttgctctcgcgaggtcgcttctctttgtatgcgccattgtagcacgtgtgtagccctactcgtaagggccatgatgacttgacgtcatccccaccttcctccagtttatcactggcagtctcctttgagttcccggccgaaccgctggcaacagaggataagggttgcgctcgttgcgggacctaacccaacatttcacaacacgagctgacgacagccatgcagcacctgtctcagagttcccgaaggcaccaaagcatctctgct

SEQ ID NO: 1084 - DNA, 406 bp, Unknown
  Uncultured seed derived bacterium of the family Xanthomonadaceae
ctccgtggtcgtcgtcccccttgcggttagactaacggcttctggagcagctcactcccatggtgtgacgggcggtgtgtacaaggcccgggaacgtattcaccgcagcatagctgatctgcgattactagcgattccgacttcatggagtcgagttgcagactccaatccggactgggatcggctttctgggattagctccacctcgcggtatcgcaaccctctgtaccgaccattgtagtacgtgtgtagccctggccgtaagggccatgatgacttgacgtcatccccaccttcctccggtttgtcaccggcagtctccttagagttcccaccattacgtgctggcaactaaggacaagggttgcgctcgttgcgggacttaacccaacatctcacgacacga

SEQ ID NO: 1085 - DNA, 388 bp, Unknown
  Uncultured seed derived bacterium of the family Sphingobacteriaceae
  misc_feature 350: N is A,T,C or G
ccctaggcggctccttgcggttaccgacttcaggcacccccagcttccatggcttgacgggcggtgtgtacaaggcccgggaacgtattcaccgcagcattgctgatcagcgattactagcgaatccaacttcatggggtcgagttgcagaccccaatccgaactgtgaatgactttgtgagattggcatcctgttgccaggtagctgccctctgtatcatccattgtagcacgtgtgtagccccggacgtaagggccatgatgacttgacgtcgtcccctccttcctctctatttgcataggcagtctgtttagagtccccaccattacatgctggcaactagacatangggttgcgctcgttgcgggacttaacccaacacctcac

SEQ ID NO: 1086 - DNA, 409 bp, Unknown
  Uncultured seed derived bacterium of the family
gtaaccgccctcctttcggttaagctagctacttctggtgcaacagactcccatggtgtgacgggcggtgtgtacaaggcccgggaacgtattcaccgcagcatgctgatctgcgattactagcgattccgacttcatgcagtcgagttgcagactgcaatccggactacgaccggttttctcggattggctccccctcgcaggtttgcaaccgtttgtaccggccattgtagcacgtgtgtagcccgccccgtgagggccatgatgacttgacgtcgtccccaccttcctccggtttgtcaccggcagtctccttagagttcccgccattacgcgctggcaactaaggacaagggttgcgctcgttacgggacttaacccaacatctcacgacacgagctgacgacag

SEQ ID NO: 1087 - DNA, 497 bp, Unknown
  Uncultured seed derived bacterium of the family Xanthobacteraceae
taccgtggtcgcctgcctccttgcggttggcgcagcgccttcgggtaaaaccaactcccatggtgtgacgggcggtgtgtacaaggcccgggaacgtattcaccgtagcatgctgatctacgattactagcgattccaccttcatgcactcgagttgcagagtgcaatctgaactgagacggcttttggagatttgcgaggggtcgcccctttgcatcccactgtcaccgccattgtagcacgtgtgtagcccagcccgtaagggccatgaggacttgacgtcgtccccaccttcctcgcggcttatcaccggcagtccccctagagtgcccaacttaatgctggcaactaggggcgagggttgcgctcgttgcgggacttaacccaacatctcacgacacgagctgacgacagccatgcagcacctgtcaccggtccagcccgaactgaaggatctcatctctgtgatccgcgaccgggatgtcaagggctggtaa

SEQ ID NO: 1088 - DNA, 447 bp, Unknown
  Uncultured seed derived bacterium of the family
acaactccgacggctatctcccttgcgggttaaatcaccggttttggttgcacccaactttcgtggtgtgacgggcggtgtgtacaaggcccgggaacgtattcaccggagccagctgatctccgattactagcgattccgccttcatgtgggcgaatttcagcccacaatctgaactggggccggcttttagagatttgctcctccttacggatttgctgctcgttgtaccggccattgtagcacgtgtgtagccctggacataaaggccatggtgacttgacgtcatccccaccttcctccccgttttccgaggcagttccctaagagtgctgtccattacagacgtggcaacatagggtaagggttgcgctcgttgcgggacttaacccaacatctcacgacacgagctgacgacagccatgcagcacctctgctagctactga

SEQ ID NO: 1089 - DNA, 439 bp, Unknown
  Uncultured seed derived bacterium of the family Burkholderiaceae
cctaccgtggggaccgtcttccttgcggttaaactagccacttctggtaaaacccactcccatggtgtgacgggcggtgtgtacaagacccgggaacgtattcaccgcggcatgctgttccgcgattactagcgattccagcttcatgcagtcgagttgcagactgcaatccggactacgatcggctttctgggattggctcaccttcgcagggtcgctgccctctggaccgaccattgtatgacgtgtgaagccctacccgtaagggccatgaggacttgacgtcatccccaccttcctccggcttgtcaccggcagtctccttagagtgccctcgcgtagcaaataaggataagggttgcgctcgttgcgggacttaacccaacatctcacgacacgagctgacgacagccatgcagcacctgtgtgttggctctct

SEQ ID NO: 1090 - DNA, 378 bp, Unknown
  Uncultured seed derived bacterium of the family Enterobacteriaceae
atcacaaagtggtaagcgccctcccgaaggttaagctacctacttcttttgcaacccactcccatggtgtgacgggcggtgtgtacaaggcccgggaacgtattcaccgtagcattctgatctacgattactagcgattccgacttcatggagtcgagttgcagactccaatccggactacgacgcactttatgaggtccgcttgctctcgcgaggtcgcttctctttgtatgcgccattgtagcacgtgtgtagccctactcgtaagggccatgatgacttgacgtcatccccaccttcctccagtttatcactggcagtctcctttgagttcccggcctaaccgctggcaacaaaggataagggttgcgctcgttg

SEQ ID NO: 1091 - DNA, 630 bp, Unknown
  Uncultured seed derived bacterium of the family EB1017
cggattccgtgccgtagctaacgtattaagtgccccgcctggggagtacggccgcaaggctaaaactcaaaggaattgacgggggcccgcacaagcggcggagcatgttgcttaattcgatgcaacgcgaagaaccttacctgggtttgacatgtagggaaaagccgtagagatacggtgtccttcggggccctacacaggtggtgcatggctgtcgtcagctcgtgtcgtgagatgttgggttaagtcccgcaacgagcgcaacccctatcctatgttgccagcgcgttatggcggggactcgtaggagactgccggtgccaaaccggaggaaggtggggatgaggtcaagtcatcatgccccttacgtccagggctgctaacatgctacaatggctggtacaaagggttgctacttcgcgagaagacgccaatcccaaaaagccagtctcagttcggattgcagtctgcaactcgactgcatgaagtcggagtcgctagtaatcgcagatcagcattgctgcggtgaatacgttcccgggccttgtacacaccgcccgtcacaccacgaaagttggtaacacccgaagccggtggcccaacccttgggagggagccgtcgaaggtggg

SEQ ID NO: 1092 - DNA, 429 bp, Unknown
  Uncultured seed derived bacterium of the family Comamonadaceae
gccgtggtaatcgccccccttgcggttaggctaactacttctggcagaacccgctcccatggtgtgacgggcggtgtgtacaagacccgggaacgtattcaccgcggcaagctgatccgcgattactagcgattccgacttcacgcagtcgagttgcagactgcgatccggactacgaccgggtttctgggattagctccccctcgcgggttggcagccctctgtcccggccattgtatgacgtgtgtagccctacccataagggccatgatgacctgacgtcatccccaccttcctccggtttgtcaccggcagtctcattagagtgccctttcgtagcaactaatgacaagggttgcgctcgttgcgggacttaacccaacatctcacgacacgagctgacgacggccatgcagcacctgtgtccag

SEQ ID NO: 1093 - DNA, 443 bp, Unknown
  Uncultured seed derived bacterium of the family Rhizobiaceae
ctaccgtggtcgcctgcccccttgcggttagcgcagcgccttcgggtaaaaccaactcccatggtgtgacgggcggtgtgtacaaggcccgggaacgtattcaccgcggcgttctgatccgcgattactagcgattccaacttcatgcactcgagttgcagagtgcaatccgaactgagatggcttttggagattagctcggggtcgccccttcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtctctacgccaccg

SEQ ID NO: 1094 - DNA, 408 bp, Unknown
  Uncultured seed derived bacterium of the family Oxalobacteraceae
  misc_feature 64: N is A,T,C or G
tggcagaacccgctcccatggtgtgacgggcggtgtgtacaagacccgggaacgtattcaccgngacatgctgatccgcgattactagcgattccaacttcatgtagtcgagttgcagactacaatccggactacgatacactttctgggattagctccccctcgcgggttggcggccctctgtatgtaccattgtatgacgtgtgaagccctacccataagggccatgaggacttgacgtcatccccaccttcctccggtttgtcaccggcagtctcattagagtgccctttcgtagcaactaatgacaagggttgcgctcgttgcgggacttaacccaacatctcacgacacgagctgacgacagccatgcagcacctgtgttacggttctctttcgagcactccc

SEQ ID NO: 1095 - DNA, 492 bp, Unknown
  Uncultured seed derived bacterium of the family
tctgcctccttgcggttagcgaaatgccttcgggtaaagccaactcccatggtgtgacgggcggtgtgtacaaggcccgggaacgtattcaccgcagcgttctgatccgcgattactagcgattccaccttcatgcacccgagttgcagagtgcaatccgaactgagacggctttttgagatttgccagggctcgcgccttcgcatcccactgtcaccgccattgtagcacgtgtgtagcccagcctgtaagggccatgaggacttgacgtcatccccaccttcctccggcttatcaccggcagtccctctagagtgcccaactaaatgatggcaactaaaggcgagggttgcgctcgttgcgggacttaacccaacatctcacgacacgagctgacgacagccatgcagcacctgtctctatgccaccgaagtggaaggtaaatctctctaccggtcataggatgtcaagggccggtaaggttctgcgcgt

SEQ ID NO: 1096 - DNA, 479 bp, Unknown
  Uncultured seed derived bacterium of the family
ccaccttcgccggaggcctccttgcggttagcctgaccgtcttctggttgagtcagctcccatggtgtgacgggcggtgtgtacaaggcccgggaacgtattcaccgcggcgtgctgatccgcgattactagcgattccaacttcatggagtcgagttgcagactccaatccgaactgagaacggctttttgagattagctccgtgttaccacttggcgtccctctgtaccgtccattgtatcacgtgtgtcgccctggatataaaggccatgaggacttgacgtcatccccaccttcctccgtgttaaccacggcagtctctttagagagcccaactgaatgctggcaactaaagacaagggttgcgctcgttgcgggacttaacccaacatgtcaccacacgagctgacgacagccatgcagcacctgtcactctgtagtattgctactaaagccctatctctagggttgtcagagg

SEQ ID NO: 1097 - DNA, 643 bp, Unknown
  Uncultured seed derived bacterium of the family Cytophagaceae
ctcgctgttggcgatacacagccagcggctaagcgcaagcgataagtaatccacctggggagtacgccggcaacggtgaaactcaaaggaattgacgggggtccgcacaagcggtggagcatgtggtttaattcgatgatacgcgaggaaccttacctgggctagaatgcctatgaccgatccagagatggataattccgcaaggacagagagcaaggtgctgcatggccgtcgtcagctcgtgccgtgaggtgttgggttaagtcccgcaacgagcgcaacccctgtttctagttgccagcacgtcaaggtggggactctagaaaaactgcccgcgcaagcggagaggaaggaggggatgacgtcaggtcatcatggcccttacgcccagggctacacacgtgctacaatggtgcctacagagtgttgcaagccagcgatggtgagccaatcacaaaaagggcatctcagttcggattgcaggctgcaactcgcctgcatgaagttggaatcgctagtaatcgcgcatcagcaatggcgcggtgtatacgttcccggaccttgtacacaccgcccgtcaagcgatggaagttgggaggacctgaagacagttgttgtaagacgctgtttagggttaaaccga

SEQ ID NO: 1098 - DNA, 459 bp, Unknown
  Uncultured seed derived bacterium of the family Comamonadaceae
cctgccgtggtaatcaccctccttgcggttaagctaactacttctggcagaacccgctcccatggtgtgacgggcggtgtgtacaagacccgggaacgtattcaccgtgacattctgatccacgattactagcgattccgacttcacgcagtcgagttgcagactgcgatccggactacgactggttttatgggattagctccccctcgcgggttggcaaccctttgtaccagccattgtatgacgtgtgtagccccacctataagggccatgaggacttgacgtcatccccaccttcctccggtttgtcaccggcagtctcattagagtgcccaactgaatgtagcaactaatgacaagggttgcgctcgttgcgggacttaacccaacatctcacgacacgagctgacgacagccatgcggcacctgtgttacggttctctttcgaacactaagcca

SEQ ID NO: 1099 - DNA, 412 bp, Unknown
  Uncultured seed derived bacterium of the family Oxalobacteraceae
taccgtggtaagcgccctccttacggttaagctacctacttctggtaaaacccgctcccatggtgtgacgggcggtgtgtacaagaccctggaacgtattcaccgcgacatgctgatccgcgattactagcgattccaacttcatgtagtcgagttgcagactacaatccggactacgatacactttctgggattagctccccctcgcgggttggcggccctctgtatgtaccattgtatgacgtgtgaagccctacccataagggccatgaggacttgacgtcatccccaccttcctccggtttgtcaccggcagtctcattagagtgccctttcgtagcaactaatgacaagggttgcgctcgttgcgggacttaacccaacatctcacgacacgagctgacgacagcca

SEQ ID NO: 1100 - DNA, 420 bp, Unknown
  Uncultured seed derived bacterium of the family Oxalobacteraceae
atcctaccgtggtgagcgccctccttgcggttaggctacccacttctggcaaaacccgctcccatggtgtgacgggcggtgtgtacaagacccgggatcgtattcaccgcgacacgctgatccgcgattactagcgattccaacttcatggagtcgagttgcagactccaatccggactacgatacactttctgggattagctccccctcgcgggttggcggccctctgtatgtaccattgtatgacgtgtgaagccctacccataagggccatgaggacttgacgtcatccccaccttcctccggtttgtcaccggcagtctcattagagtgccctttcgtagcaactaatgacaagggttgcgctcgttgcgggacttaacccaacatctcacgacacgagctgacgacagccatgca

SEQ ID NO: 1101 - DNA, 390 bp, Unknown
  Uncultured seed derived bacterium of the family Cytophagaceae
tttaaccctaaacagcgccttacagcaactggcttcaggtcctcccaactcccatggcttgacgggcggtgtgtacaaggtccgggaacgtattcaccgcaacattgctgatttgcaattactagcgattccaacttcatgcaggcgagttgcagcctgcaatccgaactgagacgtactttttgtgattggctccctgtcaccaggtcgcaacactttgtatacgccattgtagcacgtgtgtagccctggacgtaagggccatgatgacttgacgtcgtcccctccttcctctctgcttgcgcaggcagtctttttagagtccccaccattacgtgctggcaactaaaaataggggttgcgctcgttgcgggacttaacccaacacct

SEQ ID NO: 1102 - DNA, 441 bp, Unknown
  Uncultured seed derived bacterium of the family Caulobacteraceae
taccgtggtcgcctgcctctcttgcgagttagcgcagcgccttcgggtaaagccaactcccatggtgtgacgggcggtgtgtacaaggcccgggaacgtattcaccgcggcatgctgatccgcgattactagcgattccaacttcatgcactcgagttgcggagtgcaatccgagctgagacgacttttagggattggctccccctcgcgggattgcagccctctgtagtcgccattgtagcacgtgtgtagcccaccttgtaagggccatgaggacttgacgtcatccccaccttcctccgaattaacttcggcagtactattagagtgcccagccaaacctgatggcaactaatagcgagggttgcgctcgttgcgggacttaacccaacatctcacgacacgagctgacgacagccatgcagcacctgtgtcccagtc

SEQ ID NO: 1103 - DNA, 378 bp, Unknown
  Uncultured seed derived bacterium of the family Sphingomonadaceae
aaccaccgtggtcgcctgcctctcttgcgagttagcgcaacgccttcgggtgaatccaactcccatggtgtgacgggcggtgtgtacaaggcctgggaacgtattcaccgcggcatgctgatccgcgattactagcgattccgccttcatgtactcgagttgcagagtacaatccgaactgagacaacttttggagattagctcaccctcgcaggattgctgcccactgtagttgccattgtagcacgtgtgtagcccagcgcgtaagggccatgaggacttgacgtcatccccaccttcctccggcttatcaccggcggttcctttagagtacccaactaaatgatggtaactaaaggcgagggttgcgctcgtcgc

SEQ ID NO: 1104 - DNA, 449 bp, Unknown
  Uncultured seed derived bacterium of the family Burkholderiaceae
  misc_feature 107: N is A,T,C or G
ccgcggtcatcgccctccttgcggttaggctaaaggcttctggtagaaaccactcccatggtgtgacgggcggtgtgtacaagacccgggaacgtattcaccgcggnatgctgatccgcgattactagcgattccagcttcatgcagtcgagttgcagactgcaatccggactacgatccgttttctgggtttagcaccccctcgcaggttagcgtccctctgtacagaccattgtatgacgtgtgaagccctacccgtaagggccatgaggacttgacatcatccccaccttcctccggcttgtcaccggcagtctccttagagtgcccttgcgtagcaactaaggacaagggttgcgctcgttgcgggacttaacccaacatctcacgacacgagctgacgacagccatgcagcacctgtgcgccggttctcttgcgagcactcccg

SEQ ID NO: 1105 - DNA, 377 bp, Unknown
  Uncultured seed derived bacterium of the family Rhodospirillaceae
accctaccgtggtcggctgcctccttgcggttagcgcaccggcttcgggtaaagccaactcccatggtgtgacgggcggtgtgtacaaggcccgggaacgtattcaccgcagcatgctgatctgcgattactagcgattccgccttcatgcactcgagttgcagagtacaatccgaactgaggtggcttttggagatttgcttgacctcgcggtcttgcttcccactgtcaccaccattgtagcacgtgtgtagcccagcccataagggccatgaggacttgacgtcatccccgccttcctccggcttgtcaccggcggtttcgttagagtgcccagcctgactgatggcaactaacgatgagggttgcgctcgttg

SEQ ID NO: 1106 - DNA, 449 bp, Unknown
  Uncultured seed derived bacterium of the family Burkholderiaceae
agcgccctccttgcggttaggctacctacttctggtgaaacccactcccatggtgtgacgggcggtgtgtacatgacccgggaacgtattcaccgcggcatgctgatccgcgattactagcgattccagcttcacgcagtcgagttgcagactgcgatccggactacgatcggttttctgggattggctccacctcgcggcttggcaaccctctgttccgaccattgtatgacgtgtgaagccctacccataagggccatgaggacttgacgtcatccccaccttcctccggtttgtcaccggcagtctccttagagtgctcttgcgtagcaactaaggacaagggttgcgctcgttgcgggacttaacccaacatctcacgacacgagctgacgacagccatgcagcacctgtgcgccggttctctttcgagcactcccgcctctcag

SEQ ID NO: 1107 - DNA, 479 bp, Unknown
  Uncultured seed derived bacterium of the family Rhizobiaceae
accctaccgtggttagctgcctccttgcggttagcgcactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcggcctcgcggcctcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtctctacgccaccgaagtggaaactgcatctctgcaacggtcgtaag

SEQ ID NO: 1108 - DNA, 616 bp, Unknown
  Uncultured seed derived bacterium of the family Caulobacteraceae
taccgtggtcgcctgcctccttgcggttagcacagcgccttcgggtaaagccaactcccatggtgtgacgggcggtgtgtacaaggcccgggaacgtactcaccgcggcatgctgatccgcgattactagcgattccgacttcatgcactcgagttgcagagtgcaatccgaactgagacgacttttagggattggctctccatcgctggtttgcagccctctgtagtcgccattgtagcacgtgtgtagcccaccctgtaagggccatgaggacttgacgtcatccccaccttcctccggcttaccaccggcggtccctttagagtgcccaactatatgatggcaactaaaggcgagggttgcgctcgttgcgggacttaacccaacatctcacggcacgagctgacgacagccatgcagcacctgtgtcctcgtccccgaagggaactccagatctctctggatagcgaggcatgtcaaaaggtggtaaggttctgcgcgttgcttcgaattaaaccacatgctccaccgcttgtgcgggcccccgtcaattcctttgagttttaatcttgcgaccgtacaccccaggcggagtgcttaatgcgttagctgcgt

SEQ ID NO: 1109 - DNA, 441 bp, Unknown
  Uncultured seed derived bacterium of the family
cgtggtcgcctgcctccttgcggttagcgcgacgccttcgggtaaacccaactcccatggtgtgacgggcggtgtgtacaaggcccgggaacgtattcaccgtggcatgctgatccacgattactagcgattccaccttcatgcacccgagttgcagagtgcaatctgaactgagacggctttttgggattagctcgaggtcgccctttcgctgcccattgtcaccgccattgtagcacgtgtgtagcccagcctgtaagggccatgaggacttgacgtcatccccaccttcctcgcggcttatcaccggcagtcccctagagttcccaactgaatgatggcaactaggggcgagggttgcgctcgttgcgggacttaacccaacatctcacgacacgagctgacgacagccatgcagcacctgtgttccggccagccgaa

SEQ ID NO: 1110 - DNA, 434 bp, Unknown
  Uncultured seed derived bacterium of the family Rhizobiaceae
taccgtggtcgcctgcccccttgtggttagcgcagcgccttcgggtaaaaccaactcccatggtgtgacgggcggtgtgtacaaggcccgggaacgtattcaccgcggcgctctgatccgcgattactagcgattccaacttcatgcactcgagttgcagagtgcaatccgaactgagatggcttttggagattagctcggggtcgccccttcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgacctgacgacagccatgcagcacctgtctcta

SEQ ID NO: 1111 - DNA, 401 bp, Unknown
  Uncultured seed derived bacterium of the family Comamonadaceae
cgtggtaagcgccctccttgcggttaggctacctacttctggcgagacccgctcccatggtgtgacgggcggtgtgtacaagacccgggaacgtattcaccgtgacattctgatccacgattactagcgattccgacttcacgcagtcgagttgcagactgcgatccggactacgtctggctttatgggattagctccccctcgcgggttggcaaccctttgtaccagccattgtatgacgtgtgtagccccacctataagggccatgaggacttgacgtcatccccaccttcctccggtttgtcaccggcagtcccattagagtgccctttcgtagcaactaatggcaagggttgcgctcgttgcgggacttaacccaacatctcacgacacgagctgac

SEQ ID NO: 1112 - DNA, 501 bp, Unknown
  Uncultured seed derived bacterium of the family Xanthobacteraceae
taccgtggtcgcctgcctccttgcggttggcgcagcgccttcgggtaaaaccaactccatggtgtgacgggcggtgtgtacaaggcccgggaacgtattcaccgcagcatgctgatctgcgattactagcgattccaccttcatgcactcgagttgcagagtgcaatctgaactgagacggcttttggagatttgctaggggtcaccccttcgcttcccactgtcaccgccattgtagcacgtgtgtagcccagcccgtaagggccatgaggacttgacgtcatccccaccttcctcgcggcttatcaccggcagtccccctagagtgcccaactcaatgctggcaactaggggcgagggttgcgctcgttgcgggacttaacccaacatctcacgacacgagctgacgacagccatgcagcacctgtctccggtccagccgaactgaaggatctcatctctgtgatccgcgaccggratgtcaagggctggtaaggttct

SEQ ID NO: 1113 - DNA, 439 bp, Unknown
  Uncultured seed derived bacterium of the family Caulobacteraceae
ctaccgtggtcggctgcctccattgctggttagcgcaccgccttcgggtaaagccaactcccatgatgtgacgggcggtgtgtacaaggcccgggaacgtattcaccgcggcatgctgatccgcgattactagcgattccgacttcatgcactcgagttgcagagtgcaatccgaactgagacgacttttggggattagctcaccttcgcagggttgcaaccctctgtagtcgccattgtagcacgtgtgtagcgcaccttgtaagggccatgaggacttgacgtcatccccaccttcctccggcttaccaccggcggtcccattagagtgcccaacttaatgatggcaactaatggcgagagttgcgctcgttgcgggacttaacccaacatctcacgacacgagctgacgacagccatgcagcacctgtgtcccagt

SEQ ID NO: 1114 - DNA, 466 bp, Unknown
  Uncultured seed derived bacterium of the family Rhizobiaceae
ggtcgcctgcccccttgcggttagcgcagcgccttcgggtaaaaccaactcccatggtgtgacgggcggtgtgtacaaggcccggggacgtattcaccgcagcatgctgatctgcgattactagcgattccaacttcatgcactcgagttgcagagtgcaatccgaactgagatggcttttggagattagctcgacatcgctgtctcgctgcccactgtcaccaccattgtagcacgtgtgtagcccagcccgtaagggccatgaggacttgacgtcatccccaccttcctctcggcttatcaccggcagtccccttagagtgcccaactaaatgctggcaactaagggcgagggttgcgctcgttgcgggacttaacccaacatctcacgacacgagctgacgacagccatgcagcacctgttctagggcagccgaactgaaggtcatcgtctccaatgaccata

SEQ ID NO: 1115 - DNA, 509 bp, Unknown
  Uncultured seed derived bacterium of the family Rhizobiaceae
acccggttagctgcctccttgcggttagcgcactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcgacatcgctgtctcgctgcccactgtcaccaccatcgtagcacgtgtgtagcccagcccgtaagggccatgaggacttgacgtcatccccaccttcctctcggcttatcaccggcagtccccttagagtgcccaactaaatgctggcaactaagggcgagggttgcgctcgttgcgggacttaacccaacatctcacgacacgagctgacgacagccatgcagcacctgtgtcccggtccccgaagggagccttgcatctctgcaagtagccgggcatgtcaagggctggtaaggttctgcgcgttgcttcg

SEQ ID NO: 1116 - DNA, 429 bp, Unknown
  Uncultured seed derived bacterium of the family Caulobacteraceae
ggtcgcctgcctccttgcggttaacacagcgccttcgggtaaagccaactcccatggtgtgacgggcggtgtgtacacggcccgggaacgtattcaccgcggcatgctgatccgcgattactagcgattccgacttcatgcactcgagttgcagagtgcaatccgaactgagacgacttttagggattggctctccaccgctggtttgcagccctctgtagtcgccattgtagcacgtgtgtagcccaccctgtaagggccatgaggacttgacgtcatccccaccttcctccggcttaccaccggcggtccctttagagtgcccaacttaatgatggcaactaaaggcgagggttgcgctcgttgcgggacttaacccaacatctcacgacacgagctgacgacagccatgcagcacctgtgtcctcg

SEQ ID NO: 1117 - DNA, 449 bp, Unknown
  Uncultured seed derived bacterium of the family Comamonadaceae
gtaatcgccctcctagcggttaggctaactacttctggcagaacccgctcccatggtgtaacgggcggtgtgtacaagacccgggaacgtattcaccgcggcaagctgatccgcgattactagcgattccgacttcacgcagtcgagttgcagactacgatccggactacgaccgggtttctgggattagctccccctcgcgggttggcagccctctgtcccggccattgtgtgacgtgtgtagccctacccataagggccatgatgacctgacgtcatccccaccttcctccggtttgtcaccggcagtctcattagagtgccctttcgtagcaactaatgacaagggttgcgctcgttgcgggacttaacccaacatctcacgacacgagttgacgacggccatgcagcacctgtgttctggctctctttcgagcactcccaagtct

SEQ ID NO: 1118 - DNA, 434 bp, Unknown
  Uncultured seed derived bacterium of the family Comamonadaceae
tggtaagcgccctccttgcggctaggctaccaacttctggcgagacccgctcccatggtgtgacgggcggtgtgtacaagacccgggaacgtattcaccgtgacattctgatccacgattactagcgattccgacttcacgcagtcgagttgcagactgcgatccggactacgactggctttatgggattagctacccctcgcgggttggcaaccctttgtaccagccattgtatgacgtgtgtagccccacctataagggccatgaggacttgacgtcatccccaccttcctccggtttgtcaccggcagtcccattagagtgccctttcgtagcaactaatggcaagggttgcgctcgttgcgggacttaacccaacatctcacgacacgagctgacgacagccatgcagcacctgtgtgcaggttctcttt

SEQ ID NO: 1119 - DNA, 491 bp, Unknown
  Uncultured seed derived bacterium of the family Comamonadaceae
tgccgtggtaatcgccctccttgcggttaggctaactacttctggcagaacccgctcccatggtgtgacgggcggtgtgtacaagacccgggaacgtattcaccgcagcaagctgatccgcgattactagcgattccgacttcacgcagtcgagttgcagactacgatccggactacgaccgggcttctgggattagctccccctcgcgggttggcagccctctgtcccggccattgtatgacgtgtgtagccctacccataagggccatgatgacctgacgtcatccccaccttcctccggtttgtcaccggcagtctcattagagtgccctttcgtagcaactaatgacaagggttgcgctcgttgcgggacttaacccaacatctcacgacacgagctgacgacggccatgcagcacctgtgttctggctctctttcgagcactcccaaatcttttcaggattccagacatgtcaagggtaggtaagg

SEQ ID NO: 1120 - DNA, 449 bp, Unknown
  Uncultured seed derived bacterium of the family Rhizobiaceae
ctaccgtggttagctgcctccttgcggttagcgcactaccttcgggtaaaaccaactcccatggtgtgacgggcggtgtgtacaaggcccgggaacgtattcaccgcggcgtgctgatccgcgattactagcgattccaacttcatgcactcgagttgcagagtgcaatccgaactgagatggcttttggagattagctcacgctcgcgcgctcgctgcccactgtcaccaccattgtagcacgtgtgtagcctagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtctccggtccagccgaactg

SEQ ID NO: 1121 - DNA, 821 bp, Unknown
  Uncultured seed derived archaeon of the family SAGMA X
ttccggttgatcctgccggacctgactgctatcggattggtactaagccatgcgagtcattgtagcaatacaaggcggacggctcagtaacacgtagtcaacctaactcgtggacgtggataacctcgggaaactgagaacaaaccacgatagaccatagtgcctggaatggcttatggtccaaacagtttactgccatgggatgggactgcggcctatcagcttgttggtggggtaatggcccaccaaggcgattacaggtacgggctctgagaggagaagcccggagatgggtactgagacacggacccaggccctatggggcgcagcaggcgagaaaccttagcaatgtgcgaaggcacgactgggtcagcccgagtgattcctgataaaggagtcttttgcttgtcctaaaagcacaggtgaataaggggtgggcaagtctggtgtcagccgccgcggtaataccagcacctcgagtggtcaggacgtttattgggcctaaagcatccgtagccggctttgcaagtcttcggttaaatccacctgctcaacagatgggctgctggggatactacaaagctagggagtgggagaggcagacggtattcagtgggtaggggtaaaatcctctgatccattgaggaccaccagtggcgaaggcggtctgccagaacacgttcgacggtgagggatgaaagctgggggagcaaaccggattagatacccgggtagtcccagctgtaaacgatgcaaactcggtgatgcattggcttatggccaatgcagtgccgcagggaaaccgttaagtttgccgcctg

SEQ ID NO: 1122 - DNA, 760 bp, Unknown
  Uncultured seed derived archaeon of the family DHVEG 1
aacaacctctctccggcaccgagtgcccgcgtaggactcccgacaccaagaccgcagcgtttacaccctggactacccgggtatctaatccggtttgcgccccagggcttcgtccctcaccgtcggagccgttctatcacgacgccttcgccaccggtagtcccccgaggattacagaatttcacctctacccccggagtacttcgtgactctcccggtcccaagctgagcggtctacccgcggttcgaacggttaagccgttcgatttacacaggcatctactcagccggctacggacgttttaggcccaataataacggccaccactcgggctgcaggtattaccgcggcggctggcacccgtcttacccagcccttacttcctatgttttttagacaatggaacagtcggcacttagtgccggcacttggagttcccgcatcgctgtttccagcattgtgcagttttcgcgcctgctgcgccccgtagggcctgaactcgtgtcttagagttcatctccgggcgacgtctctcaacgcccgtacccgtcgtaggctagggaggccgttaccctccctacaacctgataggtcgcagtgcatcctaaggctccggagatttcgtccaggagtcattccagatctcttgggctatggggtattagcctcagtttcccgagattattccccaccttagggcaggttcaccacgtgttactgagcggtctgccgagggccgaaccctctcgactcgcaggc

SEQ ID NO: 1123 - DNA, 777 bp, Unknown
  Uncultured seed derived archaeon of the family SAGMA X
aggcggcaaacttaacggcttccctgcggcactgcattggccataagccaatgcatcaccgagtttgcatcgtttacagctgggactacccgggtatctaatccggtttgctcccccagctttcatccctcaccgtcgaacgtgttctggcagaccgccttcgccactggtggtcctcaatggatcagaggattttacccctaccctctgaataccgtctgcctctcccactccctagctttgtagtatctccagcagcccatctgttgagcaggtggatttaaccgaagacttgcaaagccggctacggatgctttaagcccaataaacgtcctgaccactcgaggtgctggtatcaccgcggcggctgacaccagacttgcccaccccttattcacctgtgcttttaggacaagcaaaagactcctttatcaggaatcactcggactgacccagtcgtgctttcgcacattgctaaggtttctcgcctgctgcgccccatagggcctgggtccgtgtctcagtacccatctccgggcttctcctctcagagcccgtacctgtaatcgccttggtgggccattacctcaccaacaagctgataggccgcagtcccatcccatggcagtaaactgtttggaccataagccattccaggcactatggtctatcgtggtttattctcagtttcccgaggttatccacgtccacgagttaggttgactacgtgttactgagccgtccgccttgtattgctacaatgactcgcatggctta

SEQ ID NO: 1124 - DNA, 762 bp, Unknown
  Uncultured seed derived archaeon of the family SAGMA X
aaacttaacggcttccctgcggcactgcattggccataagccaatgcatcaccgagtttgcatcgtttacagctgggactacccgggtatctaatccggtttgctcccccagctttcatccctcaccgtcgaacgtgttctggcagaccgccttcgccactggtggtcctcaatggatcagaggattttacccctacccactgaataccgtctgcctctcccactccctagctttgtagtatctccagcagcccatctgttgagcaggtggatttaaccgaagacttgcaaagccggctacggatgctttaggcccaataaacgtcctgaccactcgaggcgctggtattaccgcggcggctgacaccagacttgcccaccccttattcacctgtgcttttaggacaggcaaaagactcctttatcaggaatcactcggactgacccagtcgtgctttcgcatattgctaaggtttctcgcctgctgcgccccatagggcctgggtccgtgtctcagtacccatctccgggcttctcctctcagagcccgtacctgtaatcgccttggtgggccattacctcaccaacaagctgataggccgcagtcccatcccatggcagtaaactgtttggaccataagccgttccaggccctatggtctatcgtggtttattctcagtttcccgaggttatccacgtccacgagttaggttgactacgtgttaccgagccgtccgccttgtattgctacaatgactcgc

SEQ ID NO: 1125 - DNA, 823 bp, Unknown
  Uncultured seed derived archaeon of the family SAGMA X
ttccggttgatcctgccggacctgactgctatcggattggtactaagccatgcgagtcattgtagcaatacaaggcggacggctcagtaacacgtagtcaacctaactcgtggacgtggataacctcgggaaactgagaataaaccacgatagaccatagtgcctggaatggcttatggtccaaacagtttactgccatgggatgggactgcggcctatcagcttgttggagaggtaatggcccaccaaggcgattacaggtacgggctctgagaggagaagcccggagatgggtactgagacacggacccaggccctatggggcgcagcaggcgagaaaccttagcaatgtgcgaaagcacgactgggtcagttcgagtgattcctgataaaggagtcttttgcttgtcctaaaagcacaggtgaataaggggtgggcaagtctggtgtcagccgccgcggtaataccagcacctcgagtggtcaggacgtttattgggcctaaagcatccgtagccggctttgcaagtcttcggttaaatccacctgctcaacagatgggccgctggaggtactacaaagctagggagtgggagaggcagacggtattcagtgggtaggggtaaaatcctctgatccattgaggactaccagtggcgaaggcggtctgccagaacacgttcgacggtgagggatgaaagctgggggagcaaaccggattagatacccgggtagtcccaactgtaaacgatgctaactcggtgatgcattggcttatggccaatgcagtgccgcagggaagccgttaagtttgccgcctgga

SEQ ID NO: 1126 - DNA, 777 bp, Unknown
  Uncultured seed derived archaeon of the family SAGMA X
aggcggtaaacttaacggctcccctgcggcactgcattggccataagccaatgcatcactgagtttgcatcgtttacagctgggactacccgggtatctaatccggtttgctcccccagctttcatccctcaccgtcgaacgtgttctggcagaccgccttcgccactggtggtcctcaatggatcagaggattttacccctacccactgaataccgtctgcctctcccactccctagctttgtagtatctccagcagcccatctgttgagcaggtggatttaaccgaagacttgcaaagccggctacggatgctttaggcccaataaacgtcctgaccactcgaggtgctggtattaccgcggcggctgacaccagacttgcccaccccttattcacctgtgcttttaggacaagcaaaagactcctttgtcaggaatcactcggactgacccagtcgtgctttcgcacattgctaaggtttctcgcctgctgcgccccataggcctgggtccgtgtctcagtacccatctccgggcttctcctctcagagcccgtacctgtaatcgccttggtgggccattacctcaccaacaagctgataggccgcagtcccatcccatggcagtaaactgtttggaccataagccattccaggcactatggtctatcgtggtttattctcagtttcccgatgttatccacgtccacgagttaggttgactacgtgttactgagccgtccgccttgtattgctacaatgactcgcatggcctag

SEQ ID NO: 1127 - DNA, 661 bp, Unknown; identical to SEQ ID NO: 995
  Uncultured seed derived bacterium of the family Enterobacteriaceae

SEQ ID NO: 1128 - DNA, 1453 bp, Unknown
  Uncultured seed derived bacterium of the family Enterobacteriaceae
cggcaggcctaacacatgcaagtcgaacggtagcacagagagcttgctcttgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccgcagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgaaattcatgactgtgaaatgt

SEQ ID NO: 1129 - DNA, 1484 bp, Unknown
  Uncultured seed derived bacterium of the family Comamonadaceae
aatagagtttgatcctggctcagattgaacgctggcggcatgccttacacatgcaagtcgaacggcagcacgggagcaatcctggtggcgagtggcgaacgggtgagtaaagtatcggaacgtgcccagtcgtgggggataacgtagcgaaagttacgctaataccgcatacgatctatggatgaaagcgggggatcgcaagacctcgcgcgattggagcggccgatatcagattaggtagttggtggggtaaaggctcaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaaggtttgacttaatacgttggactcatgacggtaccgtaagaataagcaccggctaactacgtgccagcagccgcggtaatacgtagggtgcgagcgttaatcggaattactgggcgtaaagcgtgcgcaggcggttatgtaagacagatgtgaaatccccgggctcaacctgggaactgcattagtgactgcatagctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagttaccagagatggtttcgtgctcgaaagagaaccgtaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttataggtggggctacacacgtcatacaatggctggtacagagggttgccaacccgcgagggggagctaatcccataaaaccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgta

SEQ ID NO: 1130 - DNA, 1527 bp, Unknown
  Uncultured seed derived bacterium of the family Oxalobacteraceae
  misc_feature 1517: N is A,T,C or G
tgagcttgaatcctggctcagattgaacgctggcggcatgccttacacatgcaagtcgaacggcagcacggacttcggtctggtggcgagtggcgaacgggtgagtaatatatcggaacatacccagtagtgggggataactatccgaaaggatagctaataccgcatacgatctgtggatgaaagcaggggatcttcggaccttgtgctattggaatggccgatatctgattagctagttggtagggtaaaagcctaccaaggcgacgatcagtagctggtctgagaggacgaccagccacactggaactgagacacggtccagactcctacgggaggcagcagtggggaattttggacaatgggggcaaccctgatccagcaatgccgcgtgagtgaagaaggccctcgggttgtaaagctcttttgtcagggaagaaacggagttctctaatataggattctaatgacggtacctgaagaataagcaccggctaactacgtgccagcagccgcggtaatacgtagggtgcaagcgttaatcggaattactgggcgtaaagcgtgcgcaggcggttttgtaagtctgatgtgaaatccccgggctcaacctgggaactgcattggagactgcaaggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtctactagttgtcgggacttaattgtcttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggcaggaatcccgaagagatttgggagtgctcgcaagagaacctgcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttctgccagaagtaggtagcttaaccgcaaggagggcgcttaccacggcagggttcgtgactggggtgaagtcgtaacaaggtagccgtatcggaaggtgcgactggatcncttcctttct

SEQ ID NO: 1131 - DNA, 1508 bp, Unknown
  Uncultured seed derived bacterium of the family Comamonadaceae
  misc_feature 13, 14, 811, 812, 813, 1102: N is A,T,C or G
tgatcatggctcnnattgaacgctggcggcatgccttacacatgcaagtcgaacggcagcacgggagcaatcctggtggcgagtggcgaacgggtgagtaaagtatcggaacgtgcccagtcgtgggggataacgtagcgaaagttacgctaataccgcatacgatctatggatgaaagcgggggatcgcaagacctcgcgcgattggagcggccgatatcagattaggtagttggtggggtaaaggctcaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaaggtttggcctaataagctgagctcatgacggtaccgtaagaataagcaccggctaactacgtgccagcagccgcggtaatacgtagggtgcgagcgttaatcggaattactgggcgtaaagcgtgcgcaggcggttatgtaagacagatgtgaaatccccgggctcaacctgggaactgcattagtgactgcatagctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggnnnttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagttaccagagatggtttcgtgctcgaaagagaaccgtaacacaggtgctgcatggctgtcgtcagctcgtgtcgtgagatgttgggttaagtcccgcaacgagcgcaacccttgtcnttagttgctacgaaagggcactctaatgagactgccggtgacaaaccggaggaaggtggggatgacgtcaagtcctcatggcccttataggtggggctacacacgtcatacaatggctggtacagagggttgccaacccgcgagggggagctaatcccataaaaccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggat

SEQ ID NO: 1132 - DNA, 1498 bp, Unknown
  Uncultured seed derived bacterium of the family Pseudomonadaceae
agagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtaacc

SEQ ID NO: 1133 - DNA, 1437 bp, Unknown
  Uncultured seed derived bacterium of the family Sphingomonadaceae
aatgaacgctggcggcatgcctaacacatgcaagtcgaacgaaggcttcggccttagtggcgcacgggtgcgtaacgcgtgggaatctgccctcaggttcggaataacagcgagaaattgctgctaataccggatgatatcgcgagatcaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttaraggtgaaagcctggagctcaactccagaattgcctttaaractgcatcgcttgaatccaggagaggtgagtggaattccgagtgtagaggtgaaattcgtagatattcggaagaacaccagtggcgaaggcggctcactggactggtattgacgctraggtgcgaaagcgtggggagcaaacaggattagataccctggtagtccacgccgtaaacgatgataactactgtcggggctcttagagcttcggtggcgcactaacgccttaagttttccgcctggggagtacggccgcaaggttaaaactcaaatgaattgacgggggcctgcacaagcggtggagcatgtggtttaattcgaagcaacgcgcaraaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgtcyttagttgccatcatttagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcctaacaaggtagccgtaggggaactgc

SEQ ID NO: 1134 - DNA, 1374 bp, Unknown
  Uncultured seed derived bacterium of the family Moraxellaceae
cggcaggcttaccatgcaagtcgagcggggaaggtacttgctcctacctagcggcggacgggtgagtaatgcttaggaatctgcctattagtgggggacaacattccgaaaggaatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctactagtattaatactactggatagtggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttg

SEQ ID NO: 1135 - DNA, 1459 bp, Unknown
  Uncultured seed derived bacterium of the family Moraxellaceae
  misc_feature 128, 129, 173: N is A,T,C or G
aacgctggcggcaggcttaacacatgcaagtcgagcggatgaaggtagcttgctactggattcagcggcggacgggtgagtaatgcttaggaatctgcctattagtgggggacaacgttccgaaaggnncgctaataccgcatacgtcctacgggagaaagcaggggaccttngggccttgcgctaatagatgagcctaagtcggattagctagttggtagggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctacctagattaatactttaggatagtggacgttactcgcagaataagcaccggctaactctgtgccagcagccgcggtaatacagagggtgcgagcgttaatcggatttactgggcgtaaagcgtgcgtaggcggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcccttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatacagagaactttccagagatggattggtgccttcgggaactctgatacaggtgctgcatggctgtcgtcagctcgtgtcgtgagatgttgggttaagtcccgcaacgagcgcaacccttttccttatttgccagcacttcggttgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagt

SEQ ID NO: 1136 - DNA, 1460 bp, Unknown
  Uncultured seed derived bacterium of the family Moraxellaceae
  misc_feature 578, 763, 764, 1384: N is A,T,C or G
aacgctggcggcaggcttaacacatgcaagtcgagcggggagaggtagcttgctacctaacctagcggcggacgggtgagtaatgcttaggaatctgcctattagtgggggacaacattccgaaaggaatgctaataccgcatacgccctacgggggaaagcaggggatcttcggaccttgcgctaatagatgagcctaagtcagattagctagttggtggggtaaaggcctaccaaggcgacgatctgtagcgggtctgagaggatgatccgccacactgggactgagacacggcccagactcctacgggaggcagcagtggggaatattggacaatgggcgaaagcctgatccagccatgccgcgtgtgtgaagaaggccttttggttgtaaagcactttaagcgaggaggaggctacttggattaatactctaggatagtggacgttactcgcagaataagcaccggctaactctgtgccagcagccgcggtaatacagagggtgcgagcgttaatcggatttactgggcgtaaagcgtgcgtaggcggctttttaagtcggatgtgaaatcccngagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctnntagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggantttgttgcaccagaagtaggtagtctaaccgcaaggaggacgcttaccacggtgtggccgatgactggggtgaagt

SEQ ID NO: 1137 - DNA, 1461 bp, Unknown
  Uncultured seed derived bacterium of the family Moraxellaceae
aacgctggcggcaggcttaacacatgcaagtcgagcgggggaagttgcttcggtaactgacctagcggcggacgggtgagtaatacttaggaatctgcctattaatgggggacaacatctcgaaagggatgctaataccgcatacgccctacgggggaaagcaggggatcacttgtgaccttgcgttaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctctcttggttaatacccaagatgagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagt

SEQ ID NO: 1138 - DNA, 1460 bp, Enterobacter sp.
  misc_feature 1416: N is A,T,C or G
aacgctggcggcaggcttaacacatgcaagtcgagcggggaaatgtagcttgctacctaacctagcggcggacgggtgagtaatgcttaggaatctgcctattagtgggggacaacatctcgaaagggatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctaccgagattaatactcttggatagtggacgttactcgcagaataagcaccggctaactctgtgccagcagccgcggtaatacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgnaaggaggacgcttaccacggtgtggccgatgactggggtgaagt

SEQ ID NO: 1139 - DNA, 1475 bp, Enterobacter intermedius
tagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctta

SEQ ID NO: 1140 - DNA, 1462 bp, Curvibacter gracilis
ttgagtttgattcctggctcagattgaacgctggcggcatgccttacacatgcaagtcgaacggcagcacggacttcggtctggtggcgagtggcgaacgggtgagtaatacatcggaacgtgtcctggagtgggggatagcccggcgaaagccggattaataccgcatacgctctacggaggaaagggggggatctttcgggacctctcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcctctgccctaatacggcggggggatgacggtaccggaagaataagccccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggtttcaccagaagtaggtagcctaacctgcgaaggagggcgctaccacgtgatc

SEQ ID NO: 1141 - DNA, 1483 bp, Undibacterium sp.
  misc_feature 1465: N is A,T,C or G
tagagtttgatcctggctcagagcgaacgctggcggcaggcttaacacatgcaagtcgagcgggcatagcaatatgtcagcggcagacgggtgagtaacgcgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgnggctggatcacctcctta

SEQ ID NO: 1142 - DNA, 1340 bp, Pseudomonas lanceolata
gctgacgagtggcgaacgggtgagtaatgtatcggaacgtgcccagtcgtgggggataactgctcgaaagagcagctaataccgcatacgacctgagggtgaaagcgggggatcgcaagacctcgcgcgattggagcggccgatatcagattaggtagttggtggggtaaaggctcaccaagccaacgatctgtagctggtctgagaggacgaccagccacactgggactgagacacggcccagactcctacgggaggcagcagtggggaattttggacaatgggcgcaagcctgatccagccatgccgcgtgcgggaagaaggccttcgggttgtaaaccgcttttgtcagggaagaaaaggttctggctaatacctgggactcatgacggtacctgaagaataagcaccggctaactacgtgccagcagccgcggtaatacgtagggtgcaagcgttaatcggaattactgggcgtaaagcgtgcgcaggcggttatgcaagacagaggtgaaatccccgggctcaacctgggaactgcctttgtgactgcatagctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggagggtttcttctcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgtctggaatcctgaagagatttgggagtgctcgaaagagagccagaacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgtagtctgcaactcgactgcgtgaagtcggaatcgctagtaatcgcggatcagcttgccgcggtgaatacgttcccgggtcttgtacacaccgcccgtcacaccatgggagcgggttctgccagaagtag

SEQ ID NO: 1143 - DNA, 1495 bp, Pseudomonas plecoglossicida
  misc_feature 668: N is A,T,C or G
ttgaacgctagcgggatgccttacacatgcaagtcgaacggcagcacggacttcgtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggttaatacctcgcgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtanatatgcggaggaacaccgatggcgaaggcagcctcctgggataacactgacgctcatgcaccaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcac

SEQ ID NO: 1144 - DNA, 1435 bp, Sphingomonas echinoides
cgaacgctggcggcaggcttaacacatgcaagtcgaacgggcttcttcggaagtcagtggcagacgggtgagtaacacgtgggaacgtgcccttcggttcggaataactcagggaaacttgagctaataccggatacgcccttttggggaaaggttgactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttaccccgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagagggacgcgaaaccgcgaggttgagcaaatccccaaaagccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacc

SEQ ID NO: 1145 - DNA, 1500 bp, Acinetobacter beijerinckii
  misc_feature 563: N is A,T,C or G
agtgaacgctggcggcaggcctaacacatgcaagtcgamcggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggtngtttaagtccgttgtgaaagccctgggctcaacctgggaattgcagtggatactgggtcactagagtgtggtagagggtagcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactttaaggagaccgccggtgacaaaccggaggaaggtggggatgacgtcaagtcatcatggcccttacgaccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgc

SEQ ID NO: 1146 - DNA, 1522 bp, Acinetobacter radioresistens
  misc_feature 11, 12: N is A,T,C or G
agggtttgatnntggctcagattgaacgctggcggcatgccttacacatgcaagtcgaacggtaacaggtcttcggatgctgacgagtggcgaacgggtgagtaatacatcggaacgtgcccagtaatgggggatagctcggcgaaagccggattaataccgcatacgccctgagggggaaagtgggggaccgcaaggcctcacgttattggagcggccgatggctgattagctagttggtagggtaaaggcctaccaaggcgacgatcagtagctggtctgagaggacgatcagccacactgggactgagacacggcccagactcctacgggaggcagcagtggggaattttggacaatgggggaaaccctgatccagcaatgccgcgtgtgcgaagaaggccttcgggttgtaaagcacttttgtcagggaagaaatcctttgggctaataccctagggggatgacggtacctgaagaataagcaccggctaactacgtgccagcagccgcggtaatacgtagggtgcgagcgttaatcggaattactgggcgtaaagcgtgcgcaggcggttgtgtaagacaggtgtgaaatccccgggcttaacctgggaattgcatttgtgactgcacgactagagtgtgtcagaggggggtggaattccacgtgtagcagtgaaatgcgtagatatgtggaggaacaccaatggcgaaggcagccccctgggataacactgacgctcatgcacgaaagcgtggggagcaaacaggattagataccctggtagtccacgccctaaacgatgtcaactagttgttggggatttacttccttggtaacgtagctaacgcgtgaagttgaccgcctggggagtacggccgcaaggttaaaactcaaaggaattgacggggacccgcacaagcggtggatgatgtggattaattcgatgcaacgcgaaaaaccttacctacccttgacatggcaggaactttccagagatggattggtgctcgaaagagaacctgcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcggtacagagggttgccaagccgcgaggtggagccaatcccagaaaaccgatcgtagtccggatcgcagtctgcaactcgactgcgtgaagtcggaatcgctagtaatcgcggatcagaatgccgcggtgaatacgttcccgggtcttgtacacaccgcccgtcacaccatgggagtgggttctaccagaagtggctagtctaaccgcaaggaggacggtcaccacggtaggattcatgactggggtgaagtcgtaacaaggtagccgtatcggaaggtgcggctggatcacctccttt

SEQ ID NO: 1147 - DNA, 1437 bp, Acinetobacter johnsonii
  misc_feature 775: N is A,T,C or G
aacgaacgctggcggcaggcttaacacatgcaagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagntaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacc

SEQ ID NO: 1148 - DNA, 1511 bp, Acinetobacter sp.
tttgatcatgtctcagattgaacgctggcggcatgccttacacatgcaagtcgaacggtaacaggtcttcggatgctgacgagtggcgaacgggtgagtaatacatcggaacgtgcccgatcgtgggggataacggagcgaaagctttgctaataccgcatacgatctacggatgaaagcaggggaccgcaaggccttgcgcggacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgaaaggctgatccagccatgccgcgtgaaggatgaaggccttcgggttgtaaactgctttggtacggaacgaaaagactccttctaataaggggggtccatgacggtaccgtaagaataagcaccggctaactacgtgccagcagccgcggtaatacgtagggtgcaagcgttaatcggaattactgggcgtaaagcgtgcgcaggcggttatataagacagatgtgaaatccccgggctcaacctgggaactgcatttgtgactgtatagctagagtacggtagagggggatggaattccgcgtgtagcagtgaaatgcgtagatatgcggaggaacacccatggcgaaggcaatcccctggacctgtactgacgctcatgcacgaaagcgtggggagcaaacaggattagataccctggtagtccacgccctaaacgatgtcaactggttggtgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacagagggttgccaacccgcgagggggagccaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgcttaccacggcagggttcgtgactggggtgaagtcgtaacaaggtagccgtatcggaaggtgcggttgga

SEQ ID NO: 1149 - DNA, 1473 bp, Acinetobacter lwoffii
ggcctaacacatgcaagtctgacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatggggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtagggg

SEQ ID NO: 1150 - DNA, 1347 bp, Rhizobium pisi
ggacgggtgagtaatgtctgggaaactgcccgatggagggggataactactggaaacggtagctaataccgcataacgtcgcragaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctygccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggygtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggytcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcg

SEQ ID NO: 1151 - DNA, 1470 bp, Burkholderia ginsengisoli
tggctcagattgaacgctggcggcatgccttacacatgcaagtcgaacggtaacgcggggcaacctggcgacgagtggcgaacgggtgagtaatgcatcggaacgtgcccagtagtgggggatagcccggcgaaagccggattaataccgcatacgacctacgggtgaaagggggggatcgcaagacctctcgctattggagcggccgatgtcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagccatgccgcgtgcgggaagaaggccttcgggttgtaaaccgcttttgtcggggaagaaacggtctgcgctaataccgcgggctaatgacggtacccgaagaataagcaccggctaactacgtgccagcagccgcggtaatacgtagggtgcaagcgttaatcggaattactgggcgtaaagcgtgcgcaggcggctttgcaagacagatgtgaaatccccgggctcaacctgggaactgcatttgtgactgcatggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggacggcttgctgttcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgccaggaacttgccagagatggcttggtgctcgaaagagaacctggacacaggtgctgcatggccgtcgtcagctcgtgtcgtgagatgttgggttaagtcccgcaacgagcgcaacccttatcattagttgctacgcaagggcactctaatgagactgccggtgacaaaccggaggaaggtggggatgacgtcaggtcatcatggcccttatgggtagggctacacacgtcatacaatggccggtacacagggctgccaacccgcgagggggagctaatctcaaaaaaccgggcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggggggcgattaccacggcagggttcgtgactggggtgaagtcgtacaa

SEQ ID NO: 1152 - DNA, 1540 bp, Bradyrhizobium pachyrhizi
gtttgatcctggctcaggacgaacgctggcggcgtgcctaatacatgcaagtcgagcgaatcgacgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctggatcacctcctt

SEQ ID NO: 1153 - DNA, 1491 bp, Pelomonas puraquae
ggctcaggatgaacgctagcggcaggcctaatacatgcaagtcggacgggatccatcggtagcttgctaccgatggtgagagtggcgcacgggtgcgtaacgcgtgagcaacctgcccatatcagggggatagcccggagaaatccggattaacaccgcatgacactgctttccggcatcgggaggtggtcaaatattcataggatatggatgggctcgcgtgacattagctagttggtggggtaacggcccaccaaggcgacgatgtctaggggctctgagaggagaatcccccacactggtactgagacacggaccagactcctacgggaggcagcagtaaggaatattggtcaatgggggcaaccctgaaccagccatgccgcgtgcaggacgactgccctatgggttgtaaactgcttttgttagggaataaaccccgctacgtgtagcgggctgaatgtacctaaagaataaggatcggctaactccgtgccagcagccgcggtaatacggaggatccgagcgttatccggatttattgggtttaaagggtgcgtaggcggcactttaagtcaggggtgaaagacggcagctcaactgtcgcagtgcccttgatactgaagtgcttgaatgcggttgaagacggcggaatgagacaagtagcggtgaaatgcatagatatgtctcagaacaccgattgcgaaggcagctgtctaagccgttattgacgctgatgcacgaaagcgtggggatcgaacaggattagataccctggtagtccacgccctaaacgatgatgactcgatgtttgcgatataccgtaagcgtccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttactgaagggcgcagagacgcgcccgtccttcgggacaggaaactaggtgctgcatggctgtcgtcagctcgtgccgtgaggtgttgggttaagtcccgcaacgagcgcaacccctatgtttagttgccagcacgtcaaggtggggactctaaacagactgcctgcgcaagcagagaggaaggcggggacgacgtcaagtcatcatggcccttacgtccggggctacacacgtgctacaatggatggtacagcgggcagctacacagcaatgtggtgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagctgggggtacctaaagcatgtaaccgcaaggagcgtgttagggtaaaaccggtaattggggctaagtcgtaacaaggtagccgtaccggaaggtgcg

SEQ ID NO: 1154 - DNA, 1540 bp, Achromobacter xylosoxidans
ctggctcaggatgaacgctagcggcaggcttaatacatgcaagtcgaggggcagcatgactgtagcaatacagttgatggcgaccggcaaacgggtgcggaacacgtacgcaacctacccaaaactgggggatagcccggggaaacccggattaatacctcgtaacctagtggagtggcatcactttattagtatagctccggcggttttggatgggcgtgcgcctgattaggtagttggtgagggtaacggcccaccaagcctgcgatcagtaactggtgtgagagcacgaccagtcacacgggcactgagacacgggcccgactcctacgggaggcagcagtaaggaatattggtcaatggacgcaagtctgaaccagccatgccgcgtgaaggatgaaggtcctctggattgtaaacttcttttatatgggacgaaacccgggaattccttcccgattgacggtaccataagaataagcaccggctaactccgtgccagcagccgcggtaatacggagggtgcaagcgttatccggattcactgggtttaaagggtgcgtaggagggtaggtaagtcagtggtgaaatcttcgagcttaactcggaaactgccgttgatactatctatcttgaataccgtggaggtgagcggaatatgtcatgtagcggtgaaatgcttagatatgacatagaacaccaattgcgaaggcagctcgctacacgaatattgactctgaggcacgaaagcgtggggatcaaacaggattagataccctggtagtccacgccctaaacgatggatactcgacatacgcgatacacagtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgtagtctgaccgtgggtgaaagctcattttgtagcaatacacagattataaggtgctgcatggctgtcgtcagctcgtgccgtgaggtgttgggttaagtcccgcaacgagcgcaacccccatcactagttgccatcaggtaacgctgggaactctagtgaaactgccgtcgtaagacgcgaggaaggaggggatgatgtcaagtcatcatggcctttatgcccagggctacacacgtgctacaatggggcgtacaaagggctgccacttagcgataaggagccaatcccaaaaaacgcctctcagttcagattggagtctgcaactcgactccatgaagctggaatcgctagtaatcgtatatcagcaatgatacggtgaatacgttcccggaccttgcacacaccgcccgtcaagccatggaagctgggtgtacctaaagtcggtaaccgcaaggagccgcctaggtaaaactagtaactggggctaagtcgtaacaaggtagccgtatcggaaggtgcggctggaatacctcctttttagagcacgatcctctgggtccgccc

SEQ ID NO: 1155 - DNA, 1446 bp, Methylobacterium rhodesianum
gagtttgatcctggctcaggatgaacgctagcgggaggcctaacacatgcaagccgagcggtatgattctttcgggaatcagagagcggcgtacgggtgcggaacacgtgtgcaacctgcctttatctgggggatagcctttcgaaaggaagattaataccccataatatattgagtggcatcacttaatattgaaaactccggtggatagagatgggcacgcgcaagattagatagttggtggggtaacggcctaccaagtcgatgatctttagggggcctgagagggtgatcccccacactggtactgagacacggaccagactcctacgggaggcagcagtgaggaatattggacaatgggtgcaagcctgatccagccatcccgcgtgaaggacgacggccctatgggttgtaaacttcttttgtacagggataaacctagatacgtgtatctagctgaaggtactgtacgaataagcaccggctaactccgtgccagcagccgcggtaatacggagggtgcaagcgttatccggatttattgggtttaaagggtccgtaggcggatcagtaagtcagtggtgaaatctcatagcttaactatgaaactgccattgatactgctggtcttgagtaaggtagaagtagctggaataagtagtgtagcggtgaaatgcatagatattacttagaacaccaattgcgaaggcaggttactatgtcttaactgacgctgatggacgaaagcgtggggagcgaacaggattagataccctggtagtccacgctgtaaacgatgctaactcgtttttgggttttcggattcagagactaagcgaaagtgataagttagccacctggggagtacgaacgcaagtttgaaactcaaaggaattgacgggggcccgcacaagcggtggattatgtggtttaattcgatgatacgcgaggaaccttaccaaggcttaaatgggaattgatcggtttagaaatagaccttccttcgggcaattttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccggtacagagggcagctacacagcgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcctagggtaaaacag

SEQ ID NO: 1156 - DNA, 1488 bp, Xanthomonas sacchari
cctggctcaggatgaacgctggcggcgtgcttaacacatgcaagtcgaacgatgatcccagcttgctgggggattagtggcgaacgggtgagtaacacgtgagtaacctgcccttgactctgggataagcctgggaaactgggtctaataccggatacgaccatctggcgcatgtcatggtggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaagacctggaaacaggtgccccgcttgcggtcggtttacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggaccggcgattgggactaagtcgtaacaaggtagccgtaccggaaggtgcgg

SEQ ID NO: 1157 - DNA, 1313 bp, Limnobacter thiooxidans
ggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccacactcctacgggaggcagcagtggggaattttggacaatgggcgaaagcctgatccagcaatgccgcgtgtgtgaagaaggccttcgggttgtaaagcacttttgtccggaaagaaatcctgagggtaatatccttcggggatgacggtaccggaagaataagcaccggctaactacttgccaccacccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatg

SEQ ID NO: 1158 - DNA, 1549 bp, Agrobacterium larrymoorei
acacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggatctttggacctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgaagagatttgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcgagctaataccgcatacattgagcgttcacgcttatcggctgttgatcaagacagactcaggg

SEQ ID NO: 1159 - DNA, 1347 bp, Acidovorax facilis; identical to SEQ ID NO: 1150

SEQ ID NO: 1160 - DNA, 1485 bp, Pantoea agglomerans
attgaacgctggcggcatgccttacacatgcaagtcgaacggcagcacgggtgcttgcacctggtggcgagtggcgaacgggtgagtaatatatcggaacgtaccttgtagtgggggatagctmggcgaaagccggattaataccgcatacgctctgaggaggaaagcgggggaccttcgggcctcgcgctacaagagcggccgatatcagattagctagttggtggggtaaaagcttaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctctgggttaatacctcggggggatgacggtaccggaagaataagcaccggctaactacgtgccagcagccgcggtaatacgtagggtgcgagcgttaatcggaattactgggcgtaaagcgtgcgcaggcggttttgtaagacggatgtgaaatccccgggctcaacctgggaactgcattcgtgactgcaaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaagtctgctgagaggcggatgtgctcgaaagagaaccgtaacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggtacagagggctgccaaaccgcgaggtggagctaaccccagaaaaccgatcgtagtccggatcgcagtctgcaactcgactgcgtgaagctggaatcgctagtaatcgcggatcagcatgtcgcggtgaatacgttcccgggtcttgtacacaccgcccgtcacaccatgggagtgggttttgccagaagtaggtagcctaaccgtaaggagggcgcttaccacggcaggattcatgactggggtgaagtcgtaacaaggtagccgtakgggaacc

SEQ ID NO: 1161 - DNA, 1473 bp, Pantoea dispersa; identical to SEQ ID NO: 1149

SEQ ID NO: 1162 - DNA, 1522 bp, Methylibium aquaticum; identical to SEQ ID NO: 1146
  misc_feature 11, 12: N is A,T,C or G

SEQ ID NO: 1163 - DNA, 1495 bp, Brevibacterium frigoritolerans
attgaacgctggcggcaggcctaacacatgcaagtcgarcggtarcacagagagcttgctctcgggtgacgagyggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaascctgatgcagccatgccgcgtgtatgaagaaggccttcgggttgtaaagtactttcagcggggaggaaggcgataaggttaataaccttgtcgattgacgttacccgcagaaraagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtcmggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacctycgggagggcgcttaccactttgtgattcatgactggggtgaagtcgtaacaaggtaaccgtaggggaacctgc

SEQ ID NO: 1164 - DNA, 1519 bp, Flavobacterium mizutaii
  misc_feature 273, 274, 279, 1459, 1460, 1461, 1462: N is A,T,C or G
tggctcagagtgaacgctggcggtaggcctaacacatgcaagtcgaacggcagcacagaggagcttgctccttgggtggcgagtggcggacgggtgaggaatacatcggaatctactttttcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctnntctgngaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggctaatacccggttgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggatgggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtnnnngatgactggggtgaagtcgtaacaaggtagccgtatcggaaggtgcggctggatcac

SEQ ID NO: 1165 - DNA, 1452 bp, Flavisolibacter ginsengiterrae
tgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatga

SEQ ID NO: 1166 - DNA, 1459 bp, Chryseobacterium sp.; identical to SEQ ID NO: 1135
  misc_feature 128, 129, 173: N is A,T,C or G

SEQ ID NO: 1167 - DNA, 1498 bp, Arthrobacter nitroguaiacolicus
agagtttgatcctggctcagattgaacgctggcggaatgctttacacatgcaagtcgaacgatgaaccttagcttgctaaggggattagtggcgaacgggtgagtaatatatcggaacgtgccttgtaatgggggataactagtcgaaagattagctaataccgcatacgccctgagggggaaagtaggggatcttcggaccttacgttataagagcggccgatatctgattagctagttggtggggtaatggcctaccaaggcttcgatcagtagctggtctgagaggacgaccagccacactggaactgagacacggtccagactcctacgggaggcagcagtggggaattttggacaatgggcgcaagcctgatccagccattccgcgtgagtgaagaaggccttcgggttgtaaagctctttcgcaagggaagaaaacttacattctaataaagtgtgaggctgacggtaccttgataagaagcaccggctaactacgtgccagcagccgcggtaatacgtagggtgcgagcgttaatcggaattactgggcgtaaagcgtgcgcaggcggttttgtaagtcagatgtgaaatccccgagctcaacttgggaactgcgtttgaaactacaagactagaatatgtcagaggggggtagaattccacgtgtagcagtgaaatgcgtagagatgtggaggaataccaatggcgaaggcagccccctgggataatattgacgctcatgcacgaaagcgtggggagcaaacaggattagataccctggtagtccacgccctaaacgatgtctactagttgttggtggagtaaaatccatgagtaacgcagctaacgcgtgaagtagaccgcctggggagtacggtcgcaagattaaactcaaaggaattgacgggggcccgcacaagcggtggattatgtggattaattcgatgcaacgcgaaaaccttacctggccttgacatgccactaacgaagcagagatgcattaggtgcccgtaagggaaagtggacacaggtgctgcatggctgtcgtcagctcgtgtcgtgagatgttgggttaagtcccgcaacgagcgcaacccttgccattaattgccatcatttagttgggcactttaatgggactgccggtgacaaaccggaggaaggtggggatgacgtcaagtcctcatggcccttatggccagggcttcacacgtaatacaatggtcggtacagagagttgccaacccgcgagggggagctaatctcagaaagccgatcgtagtccggattgttctctgcaactcgagagcatgaagtcggaatcgctagtaatcgcggatcagcatgtcgcggtgaatacgttcccgggccttgtacacaccgcccgtcacaccatgggagtgggttttaccagaagtagttagtctaaccgtaagggggacgattaccacggtagtattcatgactggggtgaagtcgtaacaaggtaacc

SEQ ID NO: 1168 - DNA, 1438 bp, Burkholderia gladioli
gaacgctggcggcatgctttacacatgcaagtcgaacggcagcacgggcttcggcctggtggcgagtggcgaacgggtgagtaatatatcggaacgtacccagaagtgggggataacgtagcgaaagttacgctaataccgcatacgatctacggatgaaagtgggggaccttcgggcctcatgcttgtggagcggccgatatctgattagctagtaggtagggtaaaggcctacctaggcgacgatcagtagctggtctgagaggacgaccagccacactgggactgagacacggcccagactcctacgggaggcagcagtggggaattttggacaatgggcgcaagcctgatccagcaatgccgcgtgagtgaagaaggccttcgggttgtaaagctcttttgtcagggaagaaacggctgaggttaataccttcggctaatgacggtacctgaagaataagcaccggctaactacgtgccagcagccgcggtaatacgtagggtgcaagcgttaatcggaattactgggcgtaaagcgtgcgcaggcggttttgtaagtctgacgtgaaatccccgggctcaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggaaggaatcccgaagagatttgggagtgcccgaaagggagccttcacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattc

SEQ ID NO: 1169 - DNA, 1423 bp, Burkholderia plantarii
  misc_feature 406: N is A,T,C or G
acacatgcaagtcgaacggtaacagagagcagcttgctgctctgctgacgagtggcggacgggtgagtaatgtctgggaaactgcctgatggagggggataactactggaaacggtagctaataccgcataacgtcttcggaccaaagtgggggaccttcgggcctcatgccatcagatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaagggnttgtggttaataaccgcagtcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgaccagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccacttt

SEQ ID NO: 1170 - DNA, 1387 bp, Pantoea dispersa
caggcttaacacatgcaagtcgagcgccccgcaaggggagcggcagacgggtgagtaacgcgtgggaatctaccttttgctacggaataactcagggaaacttgtgctaataccgtatgtgcccttcgggggaaagatttatcggcaaaggatgagcccgcgttggattagctagttggtggggtaaaggcccaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccagagctcaactctggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcaagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttctgcccgaaggcactgtgctaaccgtaaggaggcaggtgaccacggtagggtcagcgactgggg

SEQ ID NO: 1171 - DNA, 1513 bp, Pandoraea sputorum
gacgaacgctggcggcgtgcctaatacatgcaagtcgagcggggttatgttagaagcttgcttctaacataacctagcggcggacgggtgagtaacacgtaggcaacctgcccatgagactgggataactaccggaaacggtagctaataccggatacatcctttccctgcatggggagaggaggaaagacggagcaatctgtcactgatggatgggcctgcggcgcattagctagttggtggggtcaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgaccggtctagagatagacctttccttcgggacaggggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaaagagcgatctggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgc

SEQ ID NO: 1172 - DNA, 1531 bp, Pantoea agglomerans
gagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaaggtggggcagatgattggggtgaagtcgtaacaaggtagccgtatcggaaggtgcggctgga

SEQ ID NO: 1173 - DNA, 1295 bp, Limnobacter thiooxidans
tcggggaacggcgggaactgccggtataccccatggtatcacattttggcatcattatgtgattaaagtaaagccccttggatcggtgtgcgttcattatagttggcggggtaacggcccaccaaggtccgatcgatagggggtgtgagagcatggccccccacacgggtactgagacacggacccgactcctacgggaggcagcagtaaggaatattggacaatgggcggaagcctgatccaccatgccgcgtgaaggacgaaggcgctcagcgttgtaaacttcttttggatgggaacaataatcgagacttgtcttgacttgagggtaccatcagaataagcaccggctaactccgtgccagcagccgcggtaatacggagggtgcaagcgttatccggaatcactgggtttaaagggtgcgtaggcggcccataggtcagtcgtgaaatcgctgggctcaacccatgcaattgcgattgatactgttggacttgaattaggttgaggctggcggaatgcgacatgtagcggtgaaatgcttagatatgtcgcagaacaccgattgcgaaggcagccagctgggcctttattgacgctgaggcacgaaagcgtggggagcaaacaggattagataccctggtagtccacgccctaaacgatgctcacttgctgttcctctttcggggggagtggcgtagggaaaccggtaagtgagccacctggggagtacgcccgcaagggtgaaactcaaaggaattgacgggggtccgcacaagcggtggagcatgtggtttaattcgatgatacgcgaggaaccttacctgggctagaatgcatttggaatatggatgaaagttcatagcctttcggggccacttgcaaggtgctgcatggctgtcgtcagctcgtgtcgtgagatgttgggttaagtcccgcaacgagcgcaacccccgtgtccagttgccagcattaagttggggactctggacagactgccgccgcaaggtgtgaggaaggtggggacgacgtcaagtcatcatggcctttatgcccagggctacacacgtgctacaatggggtgaacagagggcagctaccgcgcgagcggatgcgaatctcagaaaacaccccccagttcggattggagtctgcaacccgactccatgaaggtggaatcgctagtaatcgcgcatcagccatggcgcggtgaatacgttcccggaccttgtacacaccgcccgtcaaccatgggagcttggggccctaagacggtctttgatgactcaaacat

SEQ ID NO: 1174 - DNA, 1452 bp, Enterobacter cancerogenus
tgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagyggggaggaaggcgwtaaggttaataaccttgkcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactygactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatga

SEQ ID NO: 1175 - DNA, 1452 bp, Pseudomonas hibiscicola; identical to SEQ ID NO: 1165

SEQ ID NO: 1176 - DNA, 1432 bp, Klebsiella pneumoniae
cttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctygccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctygtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacc

SEQ ID NO: 1177 - DNA, 1348 bp, Acinetobacter radioresistens
  misc_feature 354: N is A,T,C or G
ggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgnggttaataacctcatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcg

SEQ ID NO: 1178 - DNA, 1473 bp, Methylophilus methylotrophus; identical to SEQ ID NO: 1149

SEQ ID NO: 1179 - DNA, 1495 bp, Massilia sp.; identical to SEQ ID NO: 1163

SEQ ID NO: 1180 - DNA, 1459 bp, Cronobacter turicensis
attgaacgctggcggcaggcctaacacatgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggttaccacggagtgattcatgactggggtg

SEQ ID NO: 1181 - DNA, 1494 bp, Ochrobactrum pseudogrignonense
gcggcaggcctaacacatgcaagtcgagcggaaacgacactaacaatccttcgggtgcgttaatgggcgtcgagcggcggacgggtgagtaatgcctaggaaattgccttgatgtgggggataaccattggaaacgatggctaataccgcatratgcctacgggccaaagagggggaccttcgggcctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagttgtgaggaagggggtgttgttaatagcwrcatmtcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtrctgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatccagcggagacgcaggagtgccttcgggagctctgagacaggtgctgcatggctgtcgtcagctcgtgttgtgaaatgttgggttaagtcccgcaacgagcgcaacccttatccttgtttgccagcgagtcatgtcgggaactccagggagactgccggtgataaaccggaggaaggtggggacgacgtcaagtcatcatggcccttacgagtagggctacacacgtgctacaatggcgcatacagagggcagcgagccagcgatggtaagcgaatcccaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagtaggtagtctaaccttcgggaggacgcttaccactttgtggttcatgactggggtgaagtcgtaacaaggtagccctaggggaacc

SEQ ID NO: 1182 - DNA, 1511 bp, Paenibacillus taejonensis
attgracgctggcggcaggcctaacacatgcaagtcgagcggaaacggcagtattgaagcttcggtggatttactggacgtcgagcggcggacgggtgagtaacggctgggaaccttccctgacgrgggggataaccgttggaaacgacggctaataccgcataatgtcytagatcattamgagctgggaccaaaggtggcctctacatgtaagctatcgcgttgggatgggcccagttaggattagctagttggtaaggtaatggcttaccaaggcaacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtcgtgtacttaatacgtgcacggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggttttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaagcctttagagatagaggtgtgccttcgggagcgctgagacaggtgctgcatggctgtcgtcagctcgtgttgtgaaatgttgggttaagtcccgcaacgagcgcaacccttatccttgtttgccagcacataatggtgggaactccagggagactgccggtgataaaccggaggaaggtggggacgacgtcaagtcatcatggcccttacgagtagggctacacacgtgctacaatggcagatacagagggcagcgagacagcgatgtttagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtaccc

SEQ ID NO: 1183 - DNA, 1496 bp, Bacillus stratosphericus
gtttgatcctggctcagattgaacgctggcggaatgctttacacatgcaagtcgagcggcagcgcggggcaacctggcggcgagcggcgaacgggtgagtaatacatcggaacgtacccaatcgtgggggataacacatcgaaagatgtgctaataccgcataagtcctgagggagaaagcgggggatcgcaagacctcgcgcggatggagcggccgatggcggattagctagttggtggggtaaaggcctaccaaggcgacgatccgtagctggtctgagaggacgaccagccacactggaactgagacacggtccagactcctacgggaggcagcagtggggaattttggacaatgggcgcaagcctgatccagccattccgcgtgagtgaagaaggccttcgggttgtaaagctctttcggcagggaagaaacggtttgggctaataccccgagctaatgacggtacctgaagaagaagcaccggctaactacgtgccagcagccgcggtaatacgtagggtgcgagcgttaatcggaattactgggcgtaaagcgtgcgcaggcggttttgtaagacagatgtgaaatccccgggcttaacctgggaactgcgtttgtgactgcaagactcgagtacggcagaggggggtggaattccacgtgtagcagtgaaatgcgtagagatgtggaggaacaccgatggcgaaggcagccccctgggtcgatactgacgctcatgcacgaaagcgtggggagcaaacaggattagataccctggtagtccacgccctaaacgatgccaactaggtgttggggaaggagacttccttagtaccgtagctaacgcgtgaagttggccgcctggggagtacggtcgcaagattaaaactcaaaggaattgacggggacccgcacaagcggtggatgatgtggattaattcgatgcaacgcgaaaaaccttacctacccttgacatgccaggaactttccagagatggattggtgctcgaaagagagcctggacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgggtagggcttcacacgtcatacaatggtcggtacagagggttgccaacccgcgagggggagccaatcccaataaagccgatcgtagtccggatcggagtctgcaactcgactccgtgaagtcggaatcgctagtaatcgcggatcagcatgccgcggtgaatacgttcccgggtcttgtacacaccgcccgtcacaccatgggagtgggtttcaccagaagtaggtagtctaaccgcaaggagggcgcttaccacggtgggattcatgactggggtgaagtcgtaacaaggtagccg

SEQ ID NO: 1184 - DNA, 1407 bp, Uncultured Saprospiraceae bacterium
  Uncultured seed derived bacterium of the family
gctcagattgaacgctggcggcgtgcctaacacatgcaagtcgagcggtaacaggtgtagcaatacatgctgacgagcggcggacgggtgagtaacgcttgggaatctgcctattagtgggggataactcggggaaactcgagctaataccgcatacgcactacggtggaaagctggggaccgcaaggcctggcgctaatagatgagcccaagtcggattagctagttggtagggtaatggcctaccaaggcgacgatccgtaactggtctgagaggacgaccagtcacaccggaactgagacacggtccggactcctacgggaggcagcagtggggaatattggacaatgggcgaaagcctgatccagcgacgccgcgtgggtgaagaaggcctgcgggttgtaaagccctttcagtggggaagaaaagcctcgagtgaatacctcggggtcttgacgtaacccatagaagaagcaccggctaactctgtgccagcagccgcggtaatacagagggtgcgagcgttaatcggaattactgggcgtaaagcgcgcgtaggcggctttgcaagtcggatgtgaaatccccgggctcaacctgggaactgcattcgagactgcattgctagagtatgggagagggaagtggaatttcaggtgtagcggtgaaatgcgtagatatctgaaggaacatcagtggcgaaagcgacttcctggaccaatactgacgctcatgtgcgaaagcgtggggagcaaacaggattagataccctggtagtccacgccataaacgatgagaactggatgtcgggagggttctgcctctcggtgtcgtagctaacgcgttaagttctccgcctggggagtacggccgcaaggttgaaactcaaaggaattgacggggacccgcacaagcggtggagcatgtggtttaattcgatgcaacgcgaagaaccttacctggtcttgacatcccaggaatcctgcagagatgcgggagtgccttcgggaacctggagacaggtgctgcatggctgtcgtcagctcgtgtcgtgagatgttgggttaagtcccgcaacgagcgcaacccttgcccttagttgccagcattcagttgggaactctaaggggaccgccggtgacaaaccggaggaaggtggggatgacgtcaagtcatcatggcccttatgaccagggctacacacgtgctacaatggccagtacaaagggttgccaacccgcgagggggagctaatcccataaagctggtcgtagtccggatcgcagtctgcaactcggctgcgtgaagtcggaatcgctagtaatcgtgaatcagcattgtcacggtgaatacgttcccgggtcttgtacacaccgcccgtcacaccatgggagttgattgcacca

SEQ ID NO: 1185 - DNA, 1452 bp, Klebsiella pneumoniae
ttgatcctggctcagattgaacgctggcggcatgctttacacatgcaagtcgaacggcagcgggcccttcggggtgccggcgagtggcgaacgggtgagtaatgcatcggaacgtacccaggagtgggggataaccagtcgaaagattggctaataccgcatacgtcctgagggggaaagcgggggaccgtaaggcctcgcgctcttggagcggccgatgtccgattagctagttggtggggtaaaggcctaccaaggcgacgatcggtagctggtctgagaggatgatcagccacactggaactgagacacggtccagactcctacgggaggcagcagtggggaattttggacaatgggggaaaccctgatccagccatgccgcgtgagtgaagaaggccttcgggttgtaaagctctttcggacgggaagaaatcgccctggctaatatctggggtggatgacggtaccgtaagaagaagcaccggctaactacgtgccagcagccgcggtaatacgtagggtgcgagcgttaatcggaattactgggcgtaaagcgtgcgcaggcggctcattaagacaggcgtgaaatccccgggcttaacctgggaactgcgcttgtgactggtgggctagagtgtgtcagagggaggtggaattccacgtgtagcagtgaaatgcgtagagatgtggaggaacaccgatggcgaaggcagcctcctgggataacactgacgctcatgcacgaaagcgtggggagcaaacaggattagataccctggtagtccacgccctaaacgatgtcgactagtcgttggtggagaaatccattagtgacgcagctaacgcgtgaagtcgaccgcctggggagtacggccgcaaggttaaaactcaaaggaattgacgggggcccgcacaagcggtggatgatgtggattaattcgatgcaacgcgaaaaaccttacctacccttgacatggcaggaatcctccagagatgggggagtgcccgaaagggaacctgcacacaggtgctgcatggctgtcgtcagctcgtgtcgtgagatgttgggttaagtcccgcaacgagcgcaacccttgccattagttgctacatttggttgggcactctaatgggactgccggtgacaaaccggaggaaggtggggatgacgtcaagtcctcatggcccttatgggtagggcttcacacgtcatacaatggtcggtacagagggtcgccaacccgcgagggggagccaatcccagaaagccgatcgtagtccggattgcagtctgcaactcgactgcatgaagtcggaatcgctagtaatcgcggatcagcatgtcgcggtgaatacgttcccgggccttgtacacaccgcccgtcacaccatgggagtgggtttcaccagaagtgggtagcctaaccgcaaggggggcgcttaccacgg

SEQ ID NO: 1186 - DNA, 1477 bp, Klebsiella pneumoniae
aggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataacatttagaaccgcatggttctaaagtgaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaaacttagttgccagcatttagttgggcactctaagttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtg

SEQ ID NO: 1187 - DNA, 1544 bp, Pantoea anthophila
  misc_feature 11, 12: N is A,T,C or G
agagtttgatnntggctcaggatgaacgctggcggcgtgcctaatacatgcaagtcgagcgaacagacgaggagcttgctcctttgacgttagcggcggacgggtgagtaacacgtgggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctctaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 1188 - DNA, 1467 bp, Pantoea eucalypti
cagagtttgatctggctcaggacgaacgctggcggcgtgcttaacacatgcaagtcgaacgatgaagactggtgcttgcactggttggattagtggcgaacgggtgagtaatacgtgagtaacctgcctttgactctgggataagcctgggaaactgggtctaataccggatatgacaaggaaccgcatggttttttgtggaaagggtttgtactggttttagatgggctcacggcctatcagcttgttggtggggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagcttgtaggcggtttgttgcgtctgctgtgaaagaccggggcttaaccccggtattgcagtgggtacgggcagactagagtgcagtaggggagactggaattcctggtgtagcggtgaaatgcgcagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatatactggaccgcctcagagatggggtttcccttcggggctggtatacaggtggtgcatggttgtcgtcagctcgtgtcgtgagatgtcagctcgtgtcgtgagatgttgggttaagtcccgcaacgagcgcaaccctcgttctatgttgccagcacgttgtggtggggactcataggagactgccggggtcaactcggaggaaggtggggatgacgtcaaatcatcatgccccttatgtcttgggcttcacgcatgctacaatggccggtacaaagggttgcgatactgtgaggttgagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccccttgtgggagggagtcgt

SEQ ID NO: 1189 - DNA, 1532 bp, Pantoea agglomerans
gagagtttgatcctggctcagattgaacgctggcggcaggcttaacacatgcaagtcgagcggtagcacaggggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgaacttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggctggatcacctc

SEQ ID NO: 1190 - DNA, 1508 bp, Enterobacter cancerogenus; identical to SEQ ID NO: 1131
  misc_feature 13, 14, 811, 812, 813, 1102: N is A,T,C or G

SEQ ID NO: 1191 - DNA, 1466 bp, Pseudomonas sp.
cctaacacatgcaagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttaccacggagtgattcatgactggggtgaagtcgtaacaaggtagccgtagggg

SEQ ID NO: 1192 - DNA, 1519 bp, Vibrio sp.; identical to SEQ ID NO: 1164
  misc_feature 273, 274, 279, 1459, 1460, 1461, 1462: N is A,T,C or G

SEQ ID NO: 1193 - DNA, 1498 bp, Salinivibrio costicola
attgaacgctggcggcaggcctaacacatgcaagtcgagcggtagcacagagagcttgcttcttcagggtgacgagcggcggacgggtgagtaatgtctgggaaactgcctgatggagggggataactactggaaacggtagctaataccgcataacgtcgcaagaccaaagagggggaccttgcggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtaragatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaatttagcagagatgctttagtgccttcgggaacygtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtaratcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagccgtaggggaacctgc

SEQ ID NO: 1194 - DNA, 1437 bp, Georgfuchsia toluolica; identical to SEQ ID NO: 1133

SEQ ID NO: 1195 - DNA, 1527 bp, Steroidobacter denitrificans; identical to SEQ ID NO: 1130
  misc_feature 1517: N is A,T,C or G

SEQ ID NO: 1196 - DNA, 1374 bp, Thiobacter subterraneus; identical to SEQ ID NO: 1134

SEQ ID NO: 1197 - DNA, 1466 bp, Staphylococcus  cohnii
ggcggcaggcttaacacatgcaagtcgagcggggaaaggtaccttgctacctgacctagcggcggacgggtgagtaatgcttaggaatctgcctattagtgggggacaacgttccgaaaggaacgctaataccgcatacgccctacgggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttttggttgtaaagcactttaagcgaggaggaggctcctttagttaatacctaaagagagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccctgagcttaacttaggaattgcattcgatactggaaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactaagaactttccagagatggattggtgccttcgggaacttagatacaggtgctgcatggctgtcgtcagctcgtgtcgtgagatgttgggttaagtcccgcaacgagcgcaacccttttccttatttgccatcgggtaatgccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactgggacgaagtcgtaacaaggta

SEQ ID NO: 1198 - DNA, 1460 bp, Staphylococcus hominis; identical to SEQ ID NO: 1138
  misc_feature 1416: N is A,T,C or G

SEQ ID NO: 1199 - DNA, 1462 bp, Rothia amarae; identical to SEQ ID NO: 1140

SEQ ID NO: 1200 - DNA, 1484 bp, Serratia marcescens; identical to SEQ ID NO: 1129

SEQ ID NO: 1201 - DNA, 1495 bp, Pseudomonas lanceolata; identical to SEQ ID NO: 1143
  misc_feature 668: N is A,T,C or G

SEQ ID NO: 1202 - DNA, 1347 bp, Pseudomonas oryzihabitans; identical to SEQ ID NO: 1150

SEQ ID NO: 1203 - DNA, 1516 bp, Pseudomonas hibiscicola
ttgatcctggctcagattgaacgctggcggcaggcctaacacatgcaagtcgagcggtaacaggggaagcttgcttctcgctgacgagcggcggacgggtgagtaatgtatggggatctgcccgatagagggggataactactggaaacggtagctaataccgcataatctctttggagcaaagcaggggaacttcggtccttgcgctatcggatgaacccatatgggattagctagttggtggggtaatggctcaccaaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagttgggaggaaggcgttgatgctaatatcatcaacgattgacgttaccaacagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaatggcatctaagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggctg

SEQ ID NO: 1204 - DNA, 1467 bp, Enterobacter nimipressuralis
ggctcagattgaacgctggcggcaggcttaacacatgcaagtcgagcggggacttcggtcctagcggcgaacgggtgaggaatgcttgggaatctgcccagtagcgggggataacgtttcgaaaggagcgctaataccgcatacgccctacgggggaaagggggggatcttcggacctctcactattggatgagcccaagtcggattagctagttggtggggtaaaggcctaccaaggcgacgatccgtagctggtctgagaggatgatcagccacactggaactgagacacggtccagactcctacgggaggcagcagtggggaatattggacaatgggcgaaagcctgatccagccatgccgcgtgtgtgaagaaggccttcgggttgtaaagcactttaagcgaggaggaatggctctgggttaatacccttgagcagtgacgttactcgcagaataagcaccggctaactctgtgccagcagccgcggtaatacagagggtgcaagcgttaatcggaattactgggcgtaaagcgcgcgtaggcggttgcgtaagttggatgtgaaatccccgggctcaacctgggaattgcattcaaaactgcgcggctagagtgtgggagaggaaggtagaattccaggtgtagcggtgaaatgcgtagatatctggaggaataccgatggcgaaggcagccttctggcctaacactgacgctgaggtgcgaaagcatggggagcaaacaggattagataccctggtagtccatgccgtaaacgatgtctactagccgttgggggacttgatcctttagtggcgcagctaacgcattaagtagaccgcctggggagtacggtcgcaagactaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccttgtccttagttgccagcacgtaatggtgggaactctagggagactgccggtgacaaaccggaggaaggcggggacgacgtcaagtcatcatggcccttacggccagggctacacacgtgctacaatggtcggtacaaagggttgctagcccgcgagggtacgccaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagcttaaccgcaaggagggcgcttaccacggtgtggccaatgactggggtgaagtcgtacaagg

SEQ ID NO: 1205 - DNA, 1418 bp, Sphingomonas echinoides
agcgaacgctggcggcaggcctaacacatgcaagtcgaacgaactcttcggagttagtggcggacgggtgagtaacacgtgggaacgtgccttttggttcggaataactcagggaaacttgtgctaataccgaatgtgcccttcgggggaaagatttatcgccattagagcggcccgcgtctgattagctagttggtgaggtaaaagctcaccaaggcgacgatcagtagctggtctgagaggatgaccagccacactgggactgagacacggcccagactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggcgcgtaggcggatcgttaagtcagaggtgaaatcccagggctcaaccctggaactgcctttgatactggcgatcttgagtatgagagaggtatgtggaactccgagtgtagaggtgaaattcgtagatattcggaagaacaccagtggcgaaggcgacatactggctcattactgacgctgaggcgcgaaagcgtggggagcaaacaggattagataccctggtagtccacgccgtaaacgatgattgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccacggagacgtggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcggtgcgctaaccagcaatggaggcagccgaccacggtagggtcagcgactggggtgaagtcgtaacaaggtagccgtaggggaacctgc

SEQ ID NO: 1206 - DNA, 1522 bp, Undibacterium sp.; identical to SEQ ID NO: 1146
  misc_feature 11, 12: N is A,T,C or G

SEQ ID NO: 1207 - DNA, 1475 bp, Acinetobacter beijerinckii; identical to SEQ ID NO: 1139

SEQ ID NO: 1208 - DNA, 1340 bp, Acinetobacter schindleri; identical to SEQ ID NO: 1142

SEQ ID NO: 1209 - DNA, 1390 bp, Acinetobacter lwoffii
ctggcggcgtgcctaatacatgcaagtcgaacgcttcctaccggtgcttgcaccgggaaagaagagtggcggacgggtgagtaacacgtgggtaacctacctacaagcgggggataacattcggaaacggatgctaataccgcatagatctttttgtctcctggcagaaagaagaaagacggtttcggctgtcacttgtagatggacccgcggcgcattagttagttggtgaggtaatggctcaccaagacgatgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagagaagaacaaggatgagagtaactgctcgtcccttgacggtatctaaccagaaagccatggctaactacgtgccagcagccgcggtaatacgtagatggcaagcgttgtccggatttattgggcgtaaagcgagcgcaggcggttctttaagtctgatgtgaaagcccctggctcaaccagggagggtcattggaaactggagaacttgagtgcagaagaggaaagtggaattccatgtgtagcggtgaaatgcgtagatatatggaggaacaccagtggcgaaggcgactttctggtctgtaactgacgctgaggctcgaaagcatggggagcaaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattattagttgccagcattcagttgggcactctagtgagactgccggtgataaaccggaggaaggtggggatgacgtcaaatcatcatgccccttatgacctgggctacacacgtgctacaatggatggtacaacgagtcgcaaaccgcgaggttaagctaatctcttaaagccattctcagttcggattgtaggctgcaattcgcctacatgaagccggaatcgctagtaatcgcggatcagaacgccgcggtgaatacgaacccgggccttgtacacaccgcccgtcacaccacgag

SEQ ID NO: 1210 - DNA, 1465 bp, Burkholderia ginsengisoli
tgctatacatgcaagtcgagcggaagttgaagagcttgctcttcaactttagcggcggacgggtgagtaacacgtgggcaacctgccctgcagatcgggataactccgggaaaccggtgctaataccgaatagttttgggtccctcctgggacccaacggaaagacggtttcggctgtcactgcaggatgggcccgcggcgcattagctagttggtggggtaacggcccaccaaggccacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaaactctgttgcgagggaagaaaccgtgccagctaactactggcaccttgacggtacctcgccagaaagccacggctaactacgtgccagcagccgcggtaatacgtaggtggcaagcgttgtccggaattattgggcgtaaagcgcgcgcaggcggtcccttaagtctgatgtgaaagcccacggctcaaccgtggagggtcattggaaactgggggacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccttggagacaaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggttgccaacccgcgagggggagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacagatgattggggtgaagtcgtaacaa

SEQ ID NO: 1211 - DNA, 1423 bp, Curvibacter gracilis; identical to SEQ ID NO: 1169
  misc_feature 406: N is A,T,C or G

SEQ ID NO: 1212 - DNA, 1459 bp, Achromobacter xylosoxidans; identical to SEQ ID NO: 1135
  misc_feature 128, 129, 173: N is A,T,C or G

SEQ ID NO: 1213 - DNA, 1460 bp, Pantoea dispersa
aacgctggcggcaggcttaacacatgcaagtcgagcggagtgatggtgcttgcactatcacttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctctagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactgaagttaataccttcagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagt

SEQ ID NO: 1214 - DNA, 1519 bp, Providencia rustigianii; identical to SEQ ID NO: 1164
  misc_feature 273, 274, 279, 1459, 1460, 1461, 1462: N is A,T,C or G

SEQ ID NO: 1215 - DNA, 1458 bp, Perlucidibaca piscinae
tggctcagattgaacgctggcggcaggcctaacacatgcaagtcgagcggtagagagaagcttgcttctcttgagagcggcggacgggtgagtaatacctaggaatctgcctgatagtgggggataacgttcggaaacggacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttggtgtcttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcaactagccgttgggagtcttgaactcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatg

SEQ ID NO: 1216 - DNA, 1522 bp, Brevundimonas sp.; identical to SEQ ID NO: 1146
  misc_feature 11, 12: N is A,T,C or G

SEQ ID NO: 1217 - DNA, 1495 bp, Limnobacter thiooxidans; identical to SEQ ID NO: 1163

SEQ ID NO: 1218 - DNA, 1481 bp, Rhizobium pisi
agattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataatgtcgcaagaccaaagagggggaccttcgggcctcttgccatcagatgtgcccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtacggttaataaccgtgccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacctggcagagatgccggggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaa

SEQ ID NO: 1219 - DNA, 1432 bp, Pelomonas puraquae; identical to SEQ ID NO: 1176

SEQ ID NO: 1220 - DNA, 1477 bp, Brevibacterium incertum
aatcctggctcagattgaacgctggcggcatgcctaacacatgcaagtcgaacgagggtagcaataccttagtggcggacgggtgaggaatacataggaatttgcccttaagtgggggatagcccggggaaacccggattaataccgcatgaactcgygagagcaaagtcggggaccttcgggcctggcgcttttggagaagcctatgtcggattagctagttggtgaggtaatggctcaccaaggctgcgatccgtaactggtctgagaggatgatcagtcacaccggaactgagacacggtccggactcctacgggaggcagcagtggggaatattggacaatgggcgaaagcctgatccagcaatgccgcgtgtgtgaagaaggccttcgggttgtaaagcactttaggctggaaagaaaaagctttggctaatatccaaagccttgacggtaccagcagaataagcaccggctaactctgtgccagcagccgcggtaatacagagggtgcaagcgttaatcggatttactgggcgtaaagcgtgcgtaggcggctatttaagtcggatgtgaaagccctgggcttaacctgggaactgcattcgatactgggtagctggagatcggtagagggcggcggaattccgggtgtagcggtgaaatgcgtagatatccggaggaacaccgatggcgaaggcaaccgcctgggcctgatctgacgctgaggcacgaaagcgtggggagcaaacaggattagataccctggtagtccacgctgtaaacgatgagaacttgacgtccgcttgctctgcgagtgggtgtcgaagctaacgcgctaagttctccgcctggggagtacggccgcaaggttgaaactcaaaggaattgacgggggcccgcacaagcggtggagtatgtggtttaattcgatgcaacgcgaagaaccttacctggtcttgacatgtcgagaatcctgcagagatgcgggagtgccttcgggaactcgaacacaggtgctgcatggctgtcgtcagctcgtgtcgtgagatgttgggttaagtcccgcaacgagcgcaacccttgcccttagttgccatcattcagttgggcactctaaggggaccgccggtgacaaaccggaggaaggtggggatgacgtcaagtcatcatggcccttatgaccagggctacacacgtactacaatggtcggtacagagggttgccaacccgcgagggggagctaatcccaaaaagccgatcgtagtccggattggagtctgcaactcgactccatgaagtcggaatcgctagtaatcgcggatcagcacttgtcgcggtgaatacgttcccgggccttgtacacaccgcccgtcacaccatgggagttgtttgcaccagaagtaggtagtctaaccgcaaggggggcgcttaccacggtgtggtcaatgactggggtgaagtcgtaacaaggta

SEQ ID NO: 1221 - DNA, 1452 bp, Planomicrobium glaciei; identical to SEQ ID NO: 1165

SEQ ID NO: 1222 - DNA, 1437 bp, Cronobacter turicensis
aacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacc

SEQ ID NO: 1223 - DNA, 1495 bp, Acinetobacter radioresistens; identical to SEQ ID NO: 1143
  misc_feature 668: N is A,T,C or G

SEQ ID NO: 1224 - DNA, 1434 bp, Acinetobacter calcoaceticus
tgatcctggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaag

SEQ ID NO: 1225 - DNA, 1529 bp, Pseudomonas hibiscicola
gtttgatcctggctcagattgaacgctggcggcaggcttaacacatgcaagtcgagcggtaacaggagaagcttgcttctcgctgacgagcggcggacgggtgagtaatacttaggaatctacctagtagtgggggatagcacggggaaactcgtattaataccgcatacgacctacgggagaaagggggcagtttactgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagactccgtggttaatacccacggacgatgacattagctgcagaataagcaccggctaactctgtgccagcagccgcggtaatacagagggtgcaagcgttaatcggaattactgggcgtaaagggagcgtaggtggctcgataagtcagatgtgaaatccccgggcttaacctgggaactgcatctgatactgttgagctagagtatgtgagaggaaggtagaattccaggtgtagcggtgaaatgcgtagagatctggaggaataccgatggcgaaggcagccttctggcataatactgacactgaggctcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcgggttaagccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggatagcttaaccttcgggggagcgttcaccacggtgtggttgatgactggggtgaagtcgtaacaaggtagccgtaggggaacctgcggctggatcacctccttt

SEQ ID NO: 1226 - DNA, 1549 bp, Pseudomonas fragi; identical to SEQ ID NO: 1158

SEQ ID NO: 1227 - DNA, 1403 bp, Limnobacter thiooxidans
cggacgggtgagtaatgtctggggatctgcctgatggagggggataactactggaaacggtagctaataccgcataacgtcgcaagaccaaagagggggaccttcgggcctcttgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcattaaggttaataacctyrgtgattgacgttactcgcagaagaagcaccggctaactccgtgccagcagccgcggtaatacggagggtgcaagcgttaatcggaattactgggcgtaaagcgcacgcaggcggtttgttaagtcggatgtgaaatccccgggctcaacctgggaactgcattcgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaccaaggtaa

SEQ ID NO: 1228 - DNA, 1432 bp, Enterobacter cancerogenus; identical to SEQ ID NO: 1176

SEQ ID NO: 1229 - DNA, 1473 bp, Enterobacter oryzae; identical to SEQ ID NO: 1149

SEQ ID NO: 1230 - DNA, 1449 bp, Pantoea anthophila
  misc_feature 149: N is A,T,C or G
acgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataangtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcacaaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctttaccactttgtgattcatg

SEQ ID NO: 1231 - DNA, 1532 bp, Hydrocarboniphaga effusa; identical to SEQ ID NO: 1189

SEQ ID NO: 1232 - DNA, 1490 bp, Klebsiella pneumoniae
tagagtttgaatcatggctcagattgaacgctggcggcaggcctaacacatgcaagtcgaacggtaacaggaagcagcttgctgcttcgctgacgagtggcggacgggtgagtaatgtctggggatctgcctgatggagggggataactactggaaacggtagctaataccgcataacgtcgcaagaccaaagagggggaccttcgggcctcttgccatcagatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagt

SEQ ID NO: 1233 - DNA, 1407 bp, Agrobacterium radiobacter; identical to SEQ ID NO: 1184

SEQ ID NO: 1234 - DNA, 1459 bp, Achromobacter xylosoxidans
aacgctggcggcaggcttaacacatgcaagtcgagcgggggaaggtagcttgctaccggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcgagcgttaatcggatttactgggcgtaaagcgtgcgtaggcggcttattaagtcggatgtgaaatccccgagcttaacttgggaattgcattcgatactggtgagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagt

SEQ ID NO: 1235 - DNA, 1459 bp, Candidatus Rhizobium; identical to SEQ ID NO: 1135
  misc_feature 128, 129, 173: N is A,T,C or G

SEQ ID NO: 1236 - DNA, 1484 bp, Psychrobacter urativorans
attgaacgctggcggcaggcttaacacatgcaagtcgaacgatgactctctagcttgctagagatgattagtggcggacgggtgagtaatatttaggaatctgcctagtagtgggggatagctcggggaaactcgaattaataccgcatacgacctacgggtgaaagggggcgcaagmtcttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggagaggctaatggttaatacccattagattagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacaggattagataccctggtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatctttcagagatgagagagtgccttcgggaattcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatctcaaaaagcctatcgtagtccggattggagtctgcaactcgactccatgaagtcggaatcgctagtaatcgcagatcagaatgctgcggtgaatacgttcccgggccttgtacacaccgcccgtcacaccatgggagtctattgcaccagaagtaggtagcctaacgaaagagggcgcttaccacggtgtggtcgatgactggggtgaagtcgtaacaaggtagccgtaggggaacc

SEQ ID NO: 1237 - DNA, 1513 bp, Burkholderia plantarii; identical to SEQ ID NO: 1171

SEQ ID NO: 1238 - DNA, 1512 bp, Cedecea davisae
tagagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggagccatttttagtgtgatggttggaaagttttttcggtgtaggatgagctcgcggcctatcagcttgttggtggggtaatggcctaccaaggcggcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagctttttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagggtcttttcacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgggctagagatagtctttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcccaaacttgttagggagccgtcgaaggtgggatcggcgattgggacgaagtcgtaacaaggtacccgtaccggaaggtgcggctggatcacctcctta

SEQ ID NO: 1239 - DNA, 598 bp, Pantoea anthophila
tcttggtcaattagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggcgctcgccaccaggaccacaatataaaccttttttatgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaat

SEQ ID NO: 1240 - DNA, 562 bp, Pantoea agglomerans
gaggaagtaaaagtcgtaacaaggtttccgtaggtgaacctgcggaaggatcattacctagagttgtaggctttgcctgctatctcttacccatgtcttttgagtacctttcgtttcctcggcgggtccgcccgccgattggacacattcaaaccctttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgcgcagactcgcctcaaaacaattggcagccggcgtattgatttcggagcgcagtacatctcgcgctttgcactcataacgacgacgatccaaaagtacattttttacactcttgacctcggatcaggtagggatacccgctgaacttaagcatatcaataa

SEQ ID NO: 1241 - DNA, 557 bp, Enterobacter amnigenus
ggaagtaaaagtcgtaacaaggtttccgtaggtgaacctgcggaaggatcattacctagagttgtaggctttgcctgctatctcttacccatgtcttttgagtaccttcgtttcctcggcgggttcgcccgccgattggacagtttaaaccatttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgcgtagactcgcctcaaaacaattggcagccggcgtattgatttcggagcgcagtacatctcgcgttttgcatcacaacgacgacgtccaaaagtacattttttacactcttgacctcggatcaggtagggatacccgctgaacttaagcatatcaaaggc

SEQ ID NO: 1242 - DNA, 606 bp, Serratia marcescens
tagaggaagtaaaagtcgtaacaaggtctccgttggtgaaccagcggagggatcattaccagagtgccctaggctctccaacccattgtgaacttaccaaacgttccctcggcgggctcagcgcgcggtggcctccgggcctccgggcgtccgccggggaaaaccaaaccctgatttaatcgtatttctctgaggggcgaaagcccgaaaacaaaatgaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcaggcccacccttccgggggagcgggcctggttctggggatcggcggccctcgcggcccccgtccctcaaattcagtggcggtcgcgccgcagcctcccctgcgtagtagcacaacctcgcaccggagagcggaacgaccacgccgtaaaacacccaattttttaaggttgacctcggatcaggtaggaatacccgctgaacttaagcatatcaataa

SEQ ID NO: 1243 - DNA, 562 bp, Escherichia hermannii
tcttggtcatttagaggaagtaaaagtcgtaacaaggtttccgtaggtgaacctgcggaaggatcattacctagagttgtaggctttgcctgctatctcttacccatgtcttttgagtaccttacgtttcctcggcgggtccgcccgccggttggacatacctaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgtgtagactcgcctcaaaacaattggcagccggcgtattgatttcggagcgcagtacatctcgcgctttgcactcataacgacgacgtccaaaagtacattttttacgcttgacctcggatcaggtagggatacccgctgaacttaagcatatcaaa

SEQ ID NO: 1244 - DNA, 574 bp, Steroidobacter denitrificans
agaggaagtaaaagtcgtaacaaggtctccgttggtgaaccagcggagggatcattaccgagtttacaactcccaaacccctgtgaacatacctatacgttgcctcggcggatcagcccgcgccccgtaaaaagggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaa

SEQ ID NO: 1245 - DNA, 593 bp, Acinetobacter baumannii
agaggaagtaaaagtcgtaacaaggtctccgtaggtgaacctgcggagggatcattacacaaatacaatatgaaggcttcggctggattatttatttcacccttgtcttttgcgcacttgttgtttcctgggcgggttcgcccgccaccaggaccacaccataaacctttttttatgcagttgcagtcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctttggctcgcccagagactcgccttaaaacgattggcagccggcctcctggtttcgcagcgcagcacatttttgcgcttgcaatcagcatatagaggttggcaatccatcaagactttttttttacctttgacctcggatcaggtagggatacccgctgaacttaagcatatcaata

SEQ ID NO: 1246 - DNA, 570 bp, Acinetobacter radioresistens
tcttggtcattagaggaagtaaaagtcgtaacaaggtttccgtaggtgaacctgcggaaggatcattacctagagttgtaggctttgcctgctatctcttacccatgtcttttgagtaccttcgtttcctcggcgggttcgcccgccgattggacaatttaaaccatttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgcgtagactcgcctcaaaacaattggcagccggcgtattgatttcggagcgcagtacatctcgcgttttgtatcacgacgacgacgtccaaaagtacattttttacactcttgacctcggatcaggtagggatacccgctgaacttaagcatatcaataa

SEQ ID NO: 1247 - DNA, 574 bp, Enhydrobacter aerosaccus
agaggaagtaaaagtcgtaacaaggtctccgttggtgaaccagcggagggatcattacagagttatccaactcccaaacccatgtgaacttatctctttgttgcctcggcgcaagctacccgggacctcgcgccccgggcggcccgccggcggacaaaccaaaactcttgttatcttagttgattatctgagtgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttattgttgggaacctacggcttcgtagttcctcaaagacattggcggagtggcagtggtcctctgagcgtagtaatcttttatctcgcttctgttaggtgctgcccccccggccgtaaaacccccaattttttctggttgacctcggatcaggtaggaatacccgctgaacttaagcatatcaataa

SEQ ID NO: 1248 - DNA, 609 bp, Paenibacillus taejonensis
agaggaagtaaaagtcgtaacaaggtttccgtaggtgaacctgcggaaggatcattaccgagtgagggccctctgggtccaacctcccacccgtgtttatcgtaccttgttgcttcggcgggcccgcctcacggccgccggggggcatccgcccccgggcccgcgcccgccgaagacacacaaacgaactcttgtctgaagattgcagtctgagtacttgactaaatcagttaaaactttcaacaacggatctcttggttccggcatcgatgaagaacgcagcgaaatgcgataagtaatgtgaattgcagaattcagtgaatcatcgagtctttgaacgcacattgcgccccctggtattccggggggcatgcctgtccgagcgtcattgctgccctcaagcacggcttgtgtgttgggctctcgccccccgcttccggggggcgggcccgaaaggcagcggcggcaccgcgtccggtcctcgagcgtatggggcttcgtcacccgctctgtaggcccggccggcgcccgccggcgaacaccatcaatcttaaccaggttgacctcggatcaggtagggatacccgctgaacttaagcatatcaataa

SEQ ID NO: 1249 - DNA, 590 bp, Corynebacterium sp.
agaggaagtaaaagtcgtaacaaggtctccgttggtgaaccagcggagggatcattaccgagtttcattaccgagtttacaactcccaaacccctgtgaacataccttaaacgttgcctcggcggatcagcccgcgccccgtaaaacgggacggcccgccgcaggacccttaaactctgttttctaaaagtaaattctgagtctaaaaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcgggcttaacctctaagcccggccccgaaatctagtggcggtctcgctgcagcctccattgcgtagtagctaacacctcgcaactggaacgcggcgcggccaagccgttaaacccccaacttctgaatgttgacctcggatcaggtaggaatacccgctgaacttaagcatatcaat

SEQ ID NO: 1250 - DNA, 611 bp, Cochliobolus sp.
cttggtcatttagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccacaatataaaccttttttatgcagttgcaatcagcgtcagtacaacaaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaataagcggaggaa

SEQ ID NO: 1251 - DNA, 580 bp, Phoma glomerata
tcttggtcatttagaggaagtaaaagtcgtaacaaggtttccgtaggtgaacctgcggaaggatcattacctagagttgtaggctttgcctgctatctcttacccatgtcttttgagtaccttcgtttcctcggcgggttcgcccgccgattggacaatttaaaccatttgcagttgcaatcagcgtgtgaaaaaacttaatagttacaactttcaacaacggatctcttggttctggcatcgatgaagaacgcagcgaaatgcgataagtagtgtgaattgcagaattcagtgaatcatcgaatcttttgaacgcacattgcgccccttggtattccatggggcatgcctgttcgagcgtcatttgtaccttcaagctctgcttggtgttgggtgtttgtctcgcctctgcgcgtagactcgcctcaaaacaattggcagccggcgtattgatttcggagcgcagtacatcttcgcgttttgtatcacgacgacgacgtccaaaagtacattttttacactcttgacctcggtcaggtagggatacccgctgaacttaagcatatcaataagcggagga

SEQ ID NO: 1252 - DNA, 568 bp, Phoma sp.
agaggaagtaaaagtcgtaacaaggtctccgttggtgaaccagcggagggatcattacagagttatccaactcccaaacccatgtgaacatatctctttgttgcctcggcgcaagctacccgggacctcgcgccccgggcggcccgccggcggacaaaccaaactctgttatcttcgttgattatctgagtgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttattgttgggcgtctacgtctgtagtgcctcaaagacattggcggagcggcagcagtcctctgagcgtagtaattctttatctcgcttctgttaggcgctgcccccccggccgtaaaacccccaattttttctggttgacctcggatcaggtaggaatacccgctgaacttaagcatatcaat

SEQ ID NO: 1253 - DNA, 590 bp, Acremonium strictum
tagaggaagtaaaagtcgtaacaaggtctccgtaggtgaacctgcggagggatcattacacaataaaatacgaaggccgtatacggctcacgatatattacccttgtcttttgcgcacttgttgtttcctgggcgggttcgctcgccaccaggaccacaatataaaccttttttgtgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgttttttgtcccccccaaaaaggggactcgccttaaaaggattggcagccggcctactggtttcgcagcgcagcacatttttgcgcttgcaatcagcaaaagaggacggcaatccatcaagactccttctctcgtttgacctcggatcaggtagggatacccgctgaacttaagcatatcaataa

SEQ ID NO: 1254 - DNA, 454 bp, Dothideomycete sp.
cttggtcatttagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccacaatataaaccttttttatgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaaggggactcgccttaaaa

SEQ ID NO: 1255 - DNA, 564 bp, Fusarium equiseti
ttagaggaagtaaaagtcgtaacaaggtctccgttggtgaaccagcggagggatcattaccgagtttacaactcccaaacccctgtgaacatacctatacgttgcctcggcggatcagcccgcgccctgtaaaacgggacggcccgcccgaggaccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcata

SEQ ID NO: 1256 - DNA, 626 bp, Cochliobolus sp.
  misc_feature 163: N is A,T,C or G
tcttggtcatttagaggaagtaaaagtcgtaacaaggtctccgttggtgaaccagcggagggatcattacagagttgcaaaactcccacaaaccatcgcgaatcttacccgtacggttgcctcggcgctggcggtccggaaaggccttcgggccctcccggancctcgggtctcccgctcgcgggaggctgcccgccggagtgccgaaactaaactcttgatattttatgtctctctgagtaaacttttaaataagtcaaaactttcaacaacggatctcttggttctggcatcgatgaagaacgcagcgaaatgcgataagtaatgtgaattgcagaattcagtgaatcatcgaatctttgaacgcacattgcgctcgccagtattctggcgagcatgcctgttcgagcgtcatttcaaccatcaagctctgcttgcgttggggatccgcggctgtccgcggtccctcaaaatcagtggcgggctcgctagtcacaccgagcgtagtaactctacatcgctatggtcgtgcggcgggttcttgccgtaaaaccccccatttctaaggttgacctcggatcaggtaggaatacccgctgaacttaagcatatcaataagcggagga

SEQ ID NO: 1257 - DNA, 636 bp, Phoma glomerata
tgaggaagtaaaagtcgtaacaaggtttccgtaggtgaacctgcggaaggatcattaaccgttacaaacagtgtgtgatgcggccgccgaggtgaatagcctctggttggtatggggttcgccccttcacgctcacgcgtctgccatccttactttacgagcaccttctgttctccctcggcaagggcctcgccctgccgttggaactacaaaactcttttttgcatctagcattacctgttccgacaaaaacaatcgtttacaactttcaacaatggatctcttggctctggcatcgatgaagaacgcagcgaaatgcgataagtagtgtgaattgcagaattcagtgaatcatctaatctttgaacgcacattgcgcccctcggtattccgtggggcatgcctgttcgagcgtcatctacaccctcaagctctgcttggtgttgggcgtctgtcccgcctccgcgcgtggactcgccccaaatacattggcagcggtctttgcctcctctcgcgcagcacattgcgcttctcgaggtgtcgcggacacgcgtccagtaagcaacatttaccgtctttgacctcggatcaggtagggatacccgctgaacttaagcatatcaataagcggaggaa

SEQ ID NO: 1258 - DNA, 613 bp, Nigrospora sphaerica
cttggtcatttagaggaagtaaaagtcgtaacaaggtctccgtaggtgaacctgcggagggatcattacacaaatacaatatgaaggcttcggctggattatttatttcacccttgtcttttgcgcacttgttgtttcctgggcgggttcgcccgccaccaggaccacaccataaacctttttttatgcagttgcagtcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctttggctcgcccttagactcgccttaaaacgattggcagccggcctcctggtttcgcagcgcagcacatttttgcgcttgcaatcagcatatagaggttggcaatccatcaagactttttttttacctttgacctcggatcaggtagggatacccgctgaacttaagcatatcaataagcggagga

SEQ ID NO: 1259 - DNA, 641 bp, Penicillium sp.
tcttggtcattagaggaagtaaaagtcgtaacaaggtctccgtaggtgaacctgcggagggatcattacacaacaaaaatatgagggtgtggtttgctggcaacagcgtccgccccaagtatttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctctccccttgttgggggagactcgccttaaaacgattggcagccgacctactggttttcggagcgcagcacaaatttgcgccttccaatccacggggcggcatccagcaagcctttgttttctataacaaatccacattttgacctcggatcaggtagggatacccgctgaacttaagcatatcaataagcggaggaa

SEQ ID NO: 1260 - DNA, 682 bp, Pappophorum krapovickasii
atactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgagtggagccaaactttaaaaccagtctcagttcggattgtaggctgaaactcgcctacatgaagctggagttgctagtaatcgcgaatcagaatgtcgcgtgaatacgttcccgggccttgtacacaccgcccgtcacaccatgagagttgcaatacccaaagttcgtgagctaacgcgtaaagcgggcagcgacctaaggtagggtcagcgattggggtgaagtcgtaacaaggtacc

SEQ ID NO: 1261 - DNA, 589 bp, Cochliobolus sp.
tagaggaagtaaaagtcgtaacaaggtctccgttggtgaaccagcggagggatcattaccgagtttacaactcccaaacccctgtgaacataccttaaacgttgcctcggcggatcagcccgcgccccgtaaaacgggacggcccgccgcaggacccttaaactctgttttctaaaagtaaattctgagtctaaaaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcgggcttaacctctaagcccggccccgaaatctagtggcggtctcgctgcagcctccattgcgtagtagctaacacctcgcaactggaacgcggcgcggccaagccgttaaacccccaacttctgaatgttgacctcggatcaggtaggaatacccgctgaacttaagcatatcaataagcggaggaa

SEQ ID NO: 1262 - DNA, 542 bp, Phoma sp.
tagaggaagtaaaagtcgtaacaaggtctccgtaggtgaacctgcggaggggacattacacaacaaaaatatgagggtgtggtttgctggcaacagcgtccgccccaagtatttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttccaaagggcatgcctgttcgagcgtcatttgtaccctcaagctttgcttggtgttgggcgtctttttgtctctccccttgttgggggagactcgccttaaaacgattggcagccgacctactggttttcggagcgcagcacaaatttgcgccttccaatcc

SEQ ID NO: 1263 - DNA, 593 bp, Nigrospora sp.
agaggaagtaaaagtcgtaacaaggtctccgttggtgaaccagcggagggatcattactgagtttacgctctataaccctttgtgaacatacctataactgttgcttcggcgggtagggtctccgtgaccctcccggcctcccgcccccgggcgggtcggcgcccgccggaggataaccaaactctgatttaacgacgtttcttctgagtggtacaagcaaataatcaaaacttttaacaacggatctcttggttctggcatcgatgaagaacgcagcgaaatgcgataagtaatgtgaattgcagaattcagtgaatcatcgaatctttgaacgcacattgcgcccgccagcattctggcgggcatgcctgttcgagcgtcatttcaaccctcaagctctgcttggtgttggggccctacagctgatgtaggccctcaaaggtagtggcggaccctcccggagcctcctttgcgtagtaactttacgtctcgcactgggatccggagggactcttgccgtaaaacccccaattttccaaaggttgacctcggatcaggtaggaatacccgctgaacttaagcatatcaataa

SEQ ID NO: 1264 - DNA, 494 bp, Cochliobolus hawaiiensis
agaggaagtaaaagtcgtaacaaggtctccgtaggtgaacctgcggagggatcattacacaacaaaaatatgagggtgtggtttgctggcaacagcgtccgccccaagtatttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctctccccttgttgggggagactcgccttaaaacgattggcagccgacctactggttttcgga

SEQ ID NO: 1265 - DNA, 630 bp, Cochliobolus sp.
tttggtcatttagaggaagtaaaagtcgtaacaaggtctccgtaggtgaacctgcggagggatcattacacaacaaaaatatgagggtgtggtttgctggcaacagcgtccgccccaagtatttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctctccccttgttgggggagactcgccttaaaacgattggcagccgacctactggttttcggagcgcagcacaaatttgcgccttccaatccacggggcggcatccagcaagcctttgttttctataacaaatccacattttgacctcggatcaggtagggatacccgctgaacttaagcatatcaat

SEQ ID NO: 1266 - DNA, 461 bp, Fusarium equiseti
ccgccccccctccccggggggtggctagtgcccgccagaggaccatcaaactccagtcagtgaacgtcgcagtctgaaaaaacattcaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccgaggggcatgcctgttcgagcgtcattacaaccctcaagctctgcttggtattgggcaccgcccttcttcgggcgcgcctcaaagacctcggcggtggctgtcttgcctcaagcgtagtagaatacacctcgcttcggagcgcagggcgtcgcccgccggacgaaccttctgaacttttctcaaggttgacctcggatcaggtagggatacccgctgaacttaagcatatcaata

SEQ ID NO: 1267 - DNA, 570 bp, Neurospora crassa
ttagaggaagtaaaagtcgtaacaaggtctccgtaggtgaacctgcggagggatcattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcatatcata

SEQ ID NO: 1268 - DNA, 687 bp, Leptothrium rigidum
cgacttggaggttgtgcccttgaggcgtggcttccggagctaacgcgctaagtcgaccgcctggggcgtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatgactgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatataaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggcctcgtacacaccgcccgtcacaccatgggagtgggttgcaaaagaagtaggtagcttaaccttcgggagggcgcttaccactttgtgattcatgactgggatgaagtcgtaacaaggtaac

SEQ ID NO: 1269 - DNA, 568 bp, Cochliobolus sp.
gaggaagtaaaaagtcgtaacaaggtctccgtaggtgaacctgcggagggatcattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgctcgggaggctacgccgtaaaacaaacccatttctaaggttgacctcggatcaggtagggatacccgctgaacttaagcatatcaat

SEQ ID NO: 1270 - DNA, 573 bp, Exserohilum rostratum
agaggaagtaaaagtcgtaacaaggtttccgtaggtgaacctgcggaaggaacattacctagagttgtaggctttgcctgctatctcttacccatgtcttttgagtaccttacgtttcctcggcgggtccgcccgccgattggacaaacttaaaccatttgcagttgcaatcagcgtctgaaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgtgtagactcgcctcaaaacaattggcagccggcgtattgatttcggagcgcagtacatctcgcgctttgcactcataacgacgagcgtccaaaagtacattttttacactcttgacctcggatcaggtagggatacccgctgaacttaagcatatcaataagcggaggaa

SEQ ID NO: 1271 - DNA, 687 bp, Eragrostis ciliaris; identical to SEQ ID NO: 1268

SEQ ID NO: 1272 - DNA, 682 bp, Eragrostis ciliaris
caactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatctgcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtatc

SEQ ID NO: 1273 - DNA, 560 bp, Colletotrichum gloeosporioides
agaggaagtaaaagtcgtaacaaggtttccgtaggtgaacctgcggaaggatcattacctagagttgtaggctttgcctgctatctcttacccatgtcttttgagtaccttacgtttcctcggcgggtccgcccgccgattggacactttaaaccatttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctttgcttggtgttgggtgtttgtctcgcctctgcgtgtagactcgcctcaaaacaattggcagccggcgtattgatttcggagcgcagtacatctcgcgctttgcactcataacgacgacgtccaaaagtacatttttacactcttgacctcggatcaggtagggatacccgctgaacttaagcatatcaataa

SEQ ID NO: 1274 - DNA, 575 bp, Pleosporaceae sp.
agaggaagtaaaagtcgtaacaaggtctccgtaggtgaacctgcggagggatcattacacaaaaaaatatgaaggctgactgcagctgacctacatggccagtttgctcgaggctgaattattttttcacccatgtcttttgcgcacttgttgtttcctgggcgggttcgcaaaccaccaggaccacaccataaacctttttatctgtagttgcaatcagcgtcagtaacaagtaaataatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtctttggctacagcccgaagactcgccttaaaacgattggcagccggcctactggtttcgcagcgcagcacatttttgcgcttgcaatcagcaaaagaggttggcgatccatcaagtcttactttctcactttt

SEQ ID NO: 1275 - DNA, 602 bp, Exserohilum rostratum
tagaggaagtaaaagtcgtaacaaggtctccgttggtgaaccagcggagggatcattaccgagtgtaaaaactcccaaaccattgtgaacctaccactgttgcttcggcggcctcgccccgggcgcgttcgcgcggcccggacccaggcgtccgccggaggctccaaactcttgtcttttagtgtatttctgagtggcataagcaaataaatcaaaactttcagcaacggatctcttggttctggcatcgatgaagaacgcagcaaaatgcgataagtaatgtgaattgcagaattcagtgaatcatcgaatctttgaacgcacattgcgcccgccagtattctggcgggcatgcctgtctgagcgtcatttcaaccctcaggacccgttcgcgggacctggcgttggggatcagcctgcccctggcggcggctggccctgaaatccagtggcggttccctcgcgaactcctccgtgcagtaattaaacctctcgcggcaggatagcggttgaaccacgccgttaaaccccccacttctcaaggttgacctcagatcaggtaggaatacccgctgaacttaagcatatcaataagcggagga

SEQ ID NO: 1276 - DNA, 587 bp, Botryosphaeria sp.
agaggaagtaaaagtcgtaacaaggtctccgtaggtgaacctgcggagggatcattacacaaatatgaaggcgggctggaatctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaat

SEQ ID NO: 1277 - DNA, 416 bp, Cladosporium sp.
ttgcctcggcggatcagcccgcgccccgtaaaacgggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatg

SEQ ID NO: 1278 - DNA, 601 bp, Cladosporium oxysporum
tagaggaagtaaaagtcgtaacaaggtctccgttggtgaaccagcggagggatcattacagagttgcaaaactcccacaaaccatcgcgaatcttacccgtacggttgcctcggcgctggcggtccggaaggccctcgggcccccggaccctcgggtctcccgctcgcgggaggctgcccgccggagtgccgaaaccaaactcttgatattttatgtctctctgagtaaacttttaaataagtcaaaactttcaacaacggatctcttggttctggcatcgatgaagaacgcagcgaaatgcgataagtaatgtgaattgcagaattcagtgaatcatcgaatctttgaacgcacattgcgctcgccagtattctggcgagcatgcctgttcgagcgtcatttcaaccatcaagctctgcttgcgttggggatccgcggctgcccgcggtccctcaaaaacagtggcgggctcgctagtcacaccgagcgtagtaactctacatcgctatggtcgtgcggcgggttcttgccgtaaaacccccaatttctaaggttgacctcggatcaggtaggaatacccgctgaacttaagcatatcaa

SEQ ID NO: 1279 - DNA, 567 bp, Phoma moricola
aagtaaaagtcgtaacaaggtctccgtaggtgaacctgcggagggatcattacacaaataacatatgaaggctgtacgcggctgtgccctttgggtgcagcgtctgctgcggctggattatttattttcacccttgtcttttgcgcacttgttgtttcctgggcgggttcgcccgccaccaggaccacatgataaaccttttttatgcagttgcaatcagcgtcagtacaacaaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctttgctccgccaaagactcgccttaaaacgattggcagccggcctactggtttcgcagcgcagcacatttttgcgcttgcaatcagcaaaagaggacggcactccatcaagactccttctcac

SEQ ID NO: 1280 - DNA, 471 bp, Phoma glomerata
tttggtcatttagaggaagtaaaagtcgtaacaaggtttccgtaggtgaacctgcggaaggatcattacctagagttgtaggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcggcatacatctcgcggc

SEQ ID NO: 1281 - DNA, 571 bp, Curvularia oryzae
gaggaagtaaaagtcgtaacaaggtctccgtaggtgaacctgcggagggatcattaccagtgacccccggcttcggccggggatgatcataaccctttgctgtccgactctgttgcctccggggcgaccctgcctccgggcgggggccccgggtggacacattcaaactcttgcgtaactttgcagtctgagtaaatttaattaataaattaaaactttcaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcgacgcggtccgccgcgcgcctcaaatcgaccggctgggtcttctgtcccctcagcgttgtggaaactattcgctaaagggtgccacgggaggtcacgccgtaaaacaagcccatttctaaggttgacctcggatcaggtagggatacccgctgaacttaagcatatcaataa

SEQ ID NO: 1282 - DNA, 574 bp, Acremonium alternatum
agaggaagtaaaagtcgtaacaaggtctccgttggtgaaccagcggagggatcattacagagttatccaactcccaaacccatgtgaacttatctctttgttgcctcggcgcaagctacccgggacccagcgccccgggcggcccgccggcggacaaaccaaactcttgttatcttagttgattatctgagcgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttactgttgggactctacggcctccgtagttccctaatgcgattggcggagtggcagtagtcctctgagcgtagtaattctttatctcgcttttgttaggtgctgcccccccggccgttaaacccccaattttttctggttgacctcggatcaggtaggaatacccgctgaacttaagcatatcaataa

SEQ ID NO: 1283 - DNA, 533 bp, Alternaria sp.
tttggtcatttagaggaagtaaaagtcgtaacaaggtctccgttggtgaaccagcggagggatcattaccgagtttacaactcccaaacccctgtgaacatacctatacgttgcctcggcggatcagcccgcgccctgtaaaaagggacggcccgcccgaggaccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctc

SEQ ID NO: 1284 - DNA, 537 bp, Fusarium equiseti
cattacacaataaaatacgaaggccgttcgcggctggactatttattacccttgtcttttgcgcacttgttgtttcctgggcgggttcgctcgccaccaggaccacaatataaaccttttttatgcagttgcaatcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgttttttgtcccccccaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaata

SEQ ID NO: 1285 - DNA, 637 bp, Sordaria tomento alba
tttggtcattagaggaagtaaaagtcgtaacaaggtctccgtaggtgaacctgcggagggatcattacacaataaaatatgaaggctgtacgcggctgtgctctcgggccagttttgcggaagctgaattatttattacccttgtcttttgcgcacttgttgtttcctgggcgggttcgcccgccaccaggaccacatcataaaccttttttatgcagttgcaatcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgttttttgtctttggttgccaaagactcgccttaaaaggattggcagccggcctactggtttcgcagcgcagcacatttttgcgcttgcaatcagcaaaagaggacggcaatccatcaagacttccttctcacgtttgacctcggatcaggtagggatacccgctgaacttaagcatatcaataagcggaggaa

SEQ ID NO: 1286 - DNA, 594 bp, Curvularia sichuanensis
  misc_feature 141: N is A,T,C or G
tcttggtcatttagaggaagtaaaagtcgtaacaaggtctccgtaggtgaacctgcggagggatcattacacaataaaatacgaaggccgttcgcggctggactatttattacccttgtcttttgcgcacttgttgtttcntgggcgggttcgctcgccaccaggaccacaatattaaaccttttttatgcagttgcaatcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttagaacgcacattgcgccctttggtattccaaagggcatgcctgttcgagcgtcatttgtaccctcaagctttgcttggtgttgggcgttttttgtcccccccaaaaaggggaactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaag

SEQ ID NO: 1287 - DNA, 578 bp, Phoma sp.
tcttggtcatttagaggaagtaaaagtcgtaacaaggtctccgttggtgaaccagcggagggatcattaccgagtttacaactcccaaacccctgtgaacatacctatacgttgcctcggcggatcagcccgcgccctgtaaaaagggacggcccgcccgaggaccctaaactctgtttttagtggaacttatgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagc

SEQ ID NO: 1288 - DNA, 572 bp, Cladosporium sp.
tttggtcatttagaggaagtaaaagtcgtaacaaggtctccgttggtgaaccagcggagggatcattacagagttgcaaaactccccaaaccatcgtgaacctttaccgctaaacagttgcttcggcgggtggcccgcgggtgtgcgcgcgcgcaagccgcgcccccgggggccgccgagcccgccggaggaatccaaaaaaccatcgctttcagtaccggcctctctgagttactgtacttttaattaagtcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgttcgagcgtcatttccaccatcaggcccccgggcctgtgttggggacctgcggctgcccgcaggccccgaaattcagtggcggtcgcgccgtagcaaccgagcgtagtaactaaaacgtctcggctctggctcgctgggcgcgctccggccgtaaaatacccccccttttcgcg

SEQ ID NO: 1289 - DNA, 603 bp, Nigrospora oryzae
cttggtcatttagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccacaatataaaccttttttatgcagttgcaatcagcgtcagtataacaaatgtaaatcatttacaactttcaacaacggatctcttggttctggcatcgatgaagaacgcagctgaaatgcgatacgtagtgtgaattgcagaattcagtgaatcatcgaatctttgaacgcacattgcgccctttggtattccaaagggcatgcctgtcgagcgtcattccgtaccctcaagctttgcttggtgttgggcgttttttgtcccccccaaatccctcaagctttgcttggtgttgggcgttttttgtcccccccaaatcacatttttgcgcttgcaatcagcaaaagaggacggcaatccatcaagactccttctcacgtttgacctcggatcaggtagggatacccgctgaacttaagcatatcaataagcggagga

SEQ ID NO: 1290 - DNA, 539 bp, Fusarium sp.
ggacattacagagttgcaaaactccctaaaccattgtgaagacccttaaccgttgcttcggcgggcggcgccatgccgcccctcggcccttcccgggcgcccgccggaggatacccaactcttgatattttatggccactctgagtcttctgtactgaataagtcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgttcgagcgtcatttcaaccatcaagcccccggcttgtgttggggacctgcggctgcccgcaggccctgaaaaacagtggcgggctcgctgtcacaccgagcgtagtagcatcattctcgctcagggcgtgctgcgggttccggccgttaaacgaccttcataacccaaggttgacctcggatcaggtaggaagacccgctgaacttaagcatatcaataagcggaggaa

SEQ ID NO: 1291 - DNA, 592 bp, Cochliobolus hawaiiensis
tttggtcattagaggaagtaaaagtcgtaacaaggtctccgttggtgaaccagcggagggatcattaccgagtttacaactcccaaaccccaatgtgaacgttaccaatccgttgcctcggcgggattctcttgccccgggcgcgtcgcagccccggatcccatggcgcccgccggaggaccaactccaaactcttttttctctccgtcgcggctcccgtcgcggctctgttttatttttgctctgagcctttctcggcgaccctctagcgggcgtctcgaaaatgaatcaaaactttcaacaacggatctcttggttctggcatcgatgaagaacgcagcgaaatgcgataagtaatgtgaattgcagaattcagtgaatcatcgatctttgaacgcacattgcgcccgccagtattctggcgggcatgcctgtccgagcgtcatttcaaccctcgaacccctccggggggtcggcgttggggacggcccctcaccgggccgcccccgaatacagtggcggtctcgccgcagcctctcctgcgcatatttgcaactcgcacgggacgcggcgcggcccaccgtaaacaccc

SEQ ID NO: 1292 - DNA, 609 bp, Cochliobolus lunatus
  misc_feature 509: N is A,T,C or G
cttggtcattagaggaagtaaaagtcgtaacaaggtctccgtaggtgaacctgcggagggatcattacacaatacaatatgaaggctgtgtgacgttcatcttcgacagctggattattttattacccttgtcttttgcgcacttgttgtttcctgggcgggttcgcccgccaccaggaccaccatataaaccttttttatgcagttgcaatcagcgtcagtaacaaaatgtaaatcatttacaactttcaacaacggatctcttggttctggcatcgatgaagaacgcagcgaaatgcgatacgtagtgtgaattgcagaattcagtgaatcatcgactctttgaacgcacattgcgccctttggtattccaaagggcatgcctgttcgagcgtcatttgtaccctcaagctttgcttggtgttgggcgtttttttgtctttgggtccgccaaagactcgccttaaagtgattggcagccggcctactggtttcgcagcgcagcacanttttgcgcttgcaagaggacggcaatccatcaagactcctttctcacgtttgacctcggtcaggtagggatacccgctgaacttaagcatatcaataagc

SEQ ID NO: 1293 - DNA, 610 bp, Cochliobolus sp.
tcttggtcatttagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccacaatacaaaccttttttatgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaataagcggaggaa

SEQ ID NO: 1294 - DNA, 579 bp, Fusarium sp.
tgaggaagtaaaagtcgtaacaaggtctccgttggtgaaccagcggagggatcattacagagttatccaactcccaaacccatgtgaacatatctctttgttgcctcggcgcaagctacccgggacctcgcgccccgggcggcccgccggcggacaaaccaaactctgttatcttcgttgattatctgagtgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttattgttgggcgtctacgtctgtagtgcctcaaagacattggcggagcggcagcagtcctctgagcgtagtaattctttatgtcgcttctgttaggcgctgcccccctggccgtaaaacccccaattttttctggttgacctcggatcaggtaggaatacccgctgaacttaagcatatcaataagcggaggaa

SEQ ID NO: 1295 - DNA, 525 bp, Cladorrhinum bulbillosum
acacaacaaaaatatgagggtgtggtttgctggcaacagcgtccgccccaagtatttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctctccccttgttgggggagactcgccttaaaacgattggcagccgacctactggttttcggagcgcagcacaaatttgcgccttccaatccacggggcggcatccagcaagcctttgttttctataacaaatccacattttgacctcgg

SEQ ID NO: 1296 - DNA, 491 bp, Curvularia sp.
ctacggtttacctaacactgttgcttcggcggggagccccccaggggcgagccgccggggaccactgaacttcatgcctgagagtgatgcagtctgagcctgaatacaaatcagtcaaaactttcaacaatggatctcttggttccggcatcgatgaagaacgcagcgaactgcgataagtaatgtgaattgcagaattcagtgaatcatcgagtctttgaacgcacattgcgccccctggcattccggggggcatgcctgtccgagcgtcattgctgccctcaagcccggcttgtgtgttgggtcgtcgtcccccccgggggacgggcccgaaaggcagcggcggcaccgtgtccggtcctcgagcgtatggggctttgtcacccgctcgattagggccggccgggcgccagccggcgtctccaaccttatttttctcaggttgacctcggatcaggtagggatacccgctgaacttaagcatatcaata

SEQ ID NO: 1297 - DNA, 601 bp, Corynascus kuwaitiensis
tttggtcattagaggaagtaaaagtcgtaacaaggtctccgttggtgaaccagcggagggatcattacagagttatccaactcccaaacccatgtgaacatatctctttgttgcctcggcgcaagctacccgggacctcgcgccccgggcggcccgccggcggctcgcgccccgggcggcccgccggcggtgttatctcgttgattatctgagtgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttattgttgggcgtctacgtctgtagtgcctcaaagacattggcggagcggcagcagtcctctgagcgtagtaattctttatctcgcttctgttaggcgctgcccccccggccgtaaaacccccaattttttctggttgacctcggatcaggtaggaatacccgctgaacttaagcatatcaataagcggagga

SEQ ID NO: 1298 - DNA, 590 bp, Trichoderma sp.
agaggaagtaaaagtcgtaacaaggtctccgtaggtgaacctgcggagggatcattacacaataaaatacgaaggccgttcgcggctggactatttaatacccttgtcttttgcgcacttgttgtttccagggcgggttcgctcgccaccaggaccacaatataaaccttttttatgcagttgcaatcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgttttttgtcccccccaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaataa

SEQ ID NO: 1299 - DNA, 687 bp, Cenchrus echinatus
cgacttggaggttgtgccctcgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggcgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcatcaagtgcgtcgtagtccggattggagtctgcaactcgactccatgaagtcggaatcgctagtaatcgtagatcagaatgctacggtgaatacgttcccgggccttgtacacaccgcccgtcacaccatggagtgggttgcaaaagaagtaggtagcttaaccttcgggagggcgcttaccactttgtgattcatgactgggggtgaagtcgtaacaagatagc

SEQ ID NO: 1300 - DNA, 583 bp, Cochliobolus hawaiiensis
tttggtcattagaggaagtaaaagtcgtaacaaggtctccgtaggtgaacctgcggagggatcattacaagtgaccccggtctaaccaccgggacgttctaaaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgctcgggaggctacgccgtaaaacaaacccatttctaaggttgacctcggatcaggtagggatacccgctgaacttaagcatatcaataagcg

SEQ ID NO: 1301 - DNA, 433 bp, Nigrospora sphaerica
gcctgctactcttacccatgtcttttgagtaccttacgtttcctcggcgggtccgcccgccggttggacatacctaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgtgtagactcgcctcaaaacaattggcagccggcgtattgatttcggagcgcagtacatctcgcgctttgcactcataacgacgacgtccaaaagtacattttttacgcttgacct

SEQ ID NO: 1302 - DNA, 561 bp, E. rostratum
agaggaagtaaaagtcgtaacaaggtttccgtaggtgaacctgcggaaggatcattacctagagttgtaggctttgcctgctatctcttacccatgtcttttgagtaccttcgtttcctcggcgggtccgcccgccgattggacacatttaaaccctttgtagttgcaatcagcgtctgaaaaactttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctttgcttggtgttgggtgtttgtctcgcctctgcgcgcagactcgcctcaaaacaattggcagccggcgtattgatttcggagcgcagtacatctcgcgctttgcactcataacgacgacgtccaaaaagtacattttttacactcttgacctcggatcaggtagggatacccgctgaacttaagcatatcaata

SEQ ID NO: 1303 - DNA, 624 bp, Emericella nidulans
  misc_feature 442: N is A,T,C or G
cattagaggaagtaaaagtcgtaacaaggtctccgttggtgaaccagcggagggatcattacagagttatctaactcccaaacccatgtgaacttacctttgttgcctcggcagtagttgctgggcgagcctacccgggaacgagctaccctgtagcgagttaccctggaacgacttaccctgtaacgcctgccggtggactactaaactcttgttatttttaagtaatctgagcgtcttattttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagcctagcttagtatgggaancgactttactgtcgttcctcaaattcaacggcggatttatggcaatctctgaacgtagttaattttttcctcgtttttgaaatactataaacctcagccgctaaacccccaatttttttatggttgacctcggatcaggtaggaatacccgctgaacttaagcatatcaataagcggaggaa

SEQ ID NO: 1304 - DNA, 687 bp, Sporobolus virginicus
cgacttggaggttgtgcccttgaggcgtggcttccggagctaacgcgttaagtcgaccccctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcgtacaaagagaagcgacctcgcgagagcaggcggacctcataaagtgcgtcgtagtccggattggagtctgcaactcgaccccatgaagtcggaatcgctagtaatcgtagatcagaatgctacggtgaatacgttcccgggacttgtacacaccgcccgtcacaccatgggagtgggttgcaaaagaagtaagtagcttaaccttcgggagggcgcttaccacttcgtgattcatgactggggtgaagtcgtaacaaggtacc

SEQ ID NO: 1305 - DNA, 504 bp, Cochliobolus sp.
cagtagttgctgggcgagcctacccgggaacgagctaccctgtagcaagttaccctggaacgacttaccctgtaacgcctgccggtggactactaaactcttgttatttttaagtaatctgagcgtcttattttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagcctagcttagtattgggaatcgactttactgtcgttcctcaaattcaacggcggatttatagcaatctctgaacgtagtaatttttttcctcgtttttgaaatactataaacctcagccgctaaacccccaatttttttatggttgacctcggatcaggtaggaatacccgctgaacttaagcatatcaata

SEQ ID NO: 1306 - DNA, 562 bp, Cladosporium sp.
tcttggtcatttagaggaagtaaaagtcgtaacaaggtttccgtaggtgaacctgcggaaggatcattacctagagttgtaggctttgcctgctatctcttacccatgtcttttgagtaccttacgtttcctcggcgggtccgcccgccggttggacatacctaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgtgtagactcgcctcaaaacaattggcagccggcgtattgatttcggagcgcagtacatctcgcgctttgcactcataacgacgacgtccaaaagtacattttttacgcttgacctcggatcaggtagggatacccgctgaacttaagcatatcata

SEQ ID NO: 1307 - DNA, 590 bp, Phoma sorghina
ttagaggaagtaaaagtcgtaacaaggtctccgtaggtgaacctgcggagggatcattacacaaatacaatatgaaggcttcggctggattatttatttcacccttgtcttttgcgcacttgttgttacctgggcgggttcgcccgccaccaggaccacaccataaaccttttttgtttaatgcattcagcgtcagtataacaaatgtaaatcatcctacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctttgttctccaaagactcgccttaaaacgattggcagccgacctcctggtttcgcagcgcagcacaattttgcgcttgcaatcagcaacagaggttggcactccatgaagcctttttttcttacgtttgacctcggatcaggtagggatacccgctgaacttaagcatatcaataa

SEQ ID NO: 1308 - DNA, 558 bp, Phoma sp.
tgcggagggatcattacacaataaaatacgaaggccgttcgcggctggactatttattacccttgtcttttgcgcacttgttgtttcctgggcgggttcgctcgccaccaggaccacaatataaaccttttttatgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaaggggactcgccttaaaaggattggcagccggcctactggtttcgcagcgcagcacatttttgcgcttgcaatcagcaaaagaggacggcaatccatcaagactccttctcacgtttgacctcggatcacgtagggataccctctgaacttaagcatatcaataagcggaggaa

SEQ ID NO: 1309 - DNA, 601 bp, Bartalinia robillardoides
ttttggccatttagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccacaatacaaaccttttttatgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaataa

SEQ ID NO: 1310 - DNA, 444 bp, Bartalinia pondoensis
aaaaagggacggcccgcccgaggacccctaaactctgtttttagtggaacttctgagtaaaacaaacaaataaatcaaaactttccaacaacggatgctcttggttctggcatcgatgaagaacgcagcaaaatgcgaataaggtaatgtgtaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagg

SEQ ID NO: 1311 - DNA, 611 bp, Dothideomycete sp.
tttggtcatttagaggaagtaaaagtcgtaacaaggtctccgttggtgaaccagcggagggatcattacagagttgccatctcggctctccaacccactgtgaacatacctatcgttccctcggcgggcccagcgcgcgttgcctccgggctccgggcgtccgccggggacaaccaaaccctgattttattgtgaatctctgaggggcgagagcccgaaaacaaaatgaatcataactttcaacaacggatctcttggttctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggaccccttccggggggcacctggtgctggggatcagcggcctccgggcccctgtcccccaaatgcagtggcggtcgcgccgcagcctcccctgcgtagtagcacacctcgcaccggagagcggctcggccacgccgtgaaacccccaactttcacaaggttgacctcggatcaggtaggaatacccgctgaacttaagcatatcaataa

SEQ ID NO: 1312 - DNA, 687 bp, Chloris barbata
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccggtggtaaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgtgagggcgcttaccactttgtgattcgtgactggggtgaagtcgtaacaaggtaac

SEQ ID NO: 1313 - DNA, 509 bp, Cochliobolus hawaiiensis
ttacctagagttgtaggctttgcctgctatatcttacccatgtcttttgagtacctttcgtttcctcggcgggtccgcccgccgattggacacattcaaaccctttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgcgcagactcgcctcaaaacaattggcagccggcgtattgatttcggagcgcagtacatctcgcgctttgcactcataacgacgacgatccaaaagtacattttttacactcttgacctcggatcaggtagggatacccgctgaacttaagcatatcaataa

SEQ ID NO: 1314 - DNA, 615 bp, Cochliobolus sp.
tcttggtcatttagaggaagtaaaagtcgtaacaaggtctccgttggtgaaccagcggagggatcattacagagttgcaaaactcccacaaaccatcgcgaatcttacccgtacggttgcctcggcgctggcggtccggaaggccctcgggcccccggaccctcgggtctcccgctcgcgggaggctgcccgccggagtgccgaaaccaaactcttgatattttatgtctctctgagtaaacttttaaataagtcaaaactttcaacaacggatctcttggttctggcatcgatgaagaacgcagcgaaatgcgataagtaatgtgaattgcagaattcagtgaatcatcgaatctttgaacgcacattgcgctcgccagtattctggcgagcatgcctgttcgagcgtcatttcaaccatcaagctctgcttgcgttggggatccgcggctgcccgcggtccctcaaaaacagtggcgggctcgctagtcacaccgagcgtagtaactctacatcgctatggtcgtgcggcgggttcttgccgtaaaacccccaatttctaaggttgacctcggatcaggtaggaatacccgctgaacttaagcatatcaataa

SEQ ID NO: 1315 - DNA, 496 bp, Fusarium sp.
ttatttcacccttgtcttttgcgcacttgttgtttcctgggcgggttcgcccgccaccaggaccacaccataaaccttttttgtttaatgcattcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctttgttctccaaagactcgccttaaaacgattggcagccgacctcctggtttcgcagcgcagcacaattttgcgcttgcaatcagcaacagaggttggcactccatgaagcctttttttcttacgtttgacctcggatcaggtagggatacccgctgaacttaagcatatcaataa

SEQ ID NO: 1316 - DNA, 514 bp, Nectria sp.
cggcggaggggtgccacagcctgactttatacccaccctttgcctatgtgtacccctattgcttccctcggcgggttcgcccgccgacaggaacctactaaaccctttgcattatacatttaacacttccgatacaaaactaaattattacaacttttaacaatggatctcttggttctggcatcgatgaagaacgcagcgaaatgcgataagtagtgtgaattgcagaattcagtgaatcatcgaatctttgaacgcacattgcgcccctcggtattccggggggcatgcctgttcgagcgtcatttacaccctcaagctctgcttggtgttgggcgtctgtcccgcctccgtgcgcggactcgcctcaaagtcattggcagcggtctcgtcggcttctcgcgcagcacatttgcgcttctcggagccccggcggatcagcgtccagcaagcaatttcatgacttgacctcggatcaggtagggatacccgctgaacttaagcatatcaataa

SEQ ID NO: 1317 - DNA, 574 bp, Phoma sp.
tagaggaagtaaaagtcgtaacaaggtctccgttggtgaaccagcggagggatcattacagagttatccaactcccaaacccatgtgaacttatctctttgttgcctcggcgcaagctacccgggacccagcgccccgggcggcccgccggcggacaaaccaaactcttgttatcttagttgattatctgagcgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttactgttgggactctacggcctccgtagttccccaaagcgattggcggagtggcagtagtcctctgagcgtagtaattctttatctcgcttttgttaggtgctgcccccccggccgttaaaccccccaattttttctggttgacctcggatcaggtaggaatacccgctgaacttaagcatatcata

SEQ ID NO: 1318 - DNA, 587 bp, Sordaria tomento alba
agaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccaccatataaaccttttttatgcagttgcaatcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtccccctaacaagggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaataa

SEQ ID NO: 1319 - DNA, 687 bp, Cenchrus spinifex
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 1320 - DNA, 685 bp, Cenchrus spinifex
atactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagcccgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgaggtggagccaaactttaagaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcggggcagcgacctaaggtagggtcagcgattggggtgaagtcgtaacaaggtaac

SEQ ID NO: 1321 - DNA, 570 bp, Nigrospora oryzae
tttggtcatttagaggaagtaaaagtcgtaacaaggtttccgtaggtgaacctgcggaaggatcattatcaaaacagcggacttcggtccttgctgcacccttgtcttttgcgtaccgtatgtttcctcggcgggcttgcctgccggttggacattatcaaacctttttgtagttgcaatcagcgtcagaaaataataataattacaactttcaacaacggatctcttggttctggcatcgatgaagaacgcagcgaaatgcgaaaagtagtgtgaattgcagaattcagtgaatcatcgaatctttgaacgcacattgcgccccttggtattccatggggcatgcctgttcgagcgtcattttgtaccctcaagcactgcttggtgttgggcgcttgtcctgcaaaggactcgcctgaaagcgattggcggccaacgtactggtggtagagcgcagcacaatttgcgtctttcccctctgcgttagcgtccataaagcctatttcaacgtttgacctcggatcaggtagggatacccgctgaacttaagcatatcaataagcggaggaa

SEQ ID NO: 1322 - DNA, 469 bp, Cochliobolus australiensis
tgaggaagtaaaagtcgtaacaaggtttccgtaggtgaacctgcggaaggatcattacctagagttgtaggctttgcctgctatctcttacccatgtcttttgagtaccttcgtttcctcggcgggtccgcccgccgattggacatacttaaaccctttgtaattgaaatcagcgtctgaaaaacttttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctttgcttggtgttgggtgtttgtctcgcctctgcgcgcagactcgcctcaaaacaattggcagccggcgtattgatttcggagcgcagtacatctcgcgctc

SEQ ID NO: 1323 - DNA, 511 bp, Phoma leveillei
tacctagagttgcgggctttgcctgccatctcttacccatgtcttttgagtaccttacgtttcctcggtgggttcgcccgccggctggacaacattcaaaccctttgtagttgcaatcagcgtctgaaaaacttttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgccttttgcgcgcagactcgcctcaaaacgattggcagccggcgtattgatttcggagcgcagtacatctcgcgctttgcactcataacgacgacgtccaaaaagtacattttttacactcttgacctcggatcaggtagggatacccgctgaacttaagcatatcaataa

SEQ ID NO: 1324 - DNA, 554 bp, Phoma sp.
tatgaggggtgggtttgctggcaacagcgtccgccccaagtattttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagcttgacttggtgttgggcgtctttttgtctctccccttgttgggggagactcgccttaaaacgattggcagccgacctactggttttcggagcgcagcacaaatttgcgccttccaatccacggggcggcatccagcaagcctttgttttctataacaaatccacattttgacctcggatcaggtagggatacccgctgaacttaagcatatcaataa

SEQ ID NO: 1325 - DNA, 571 bp, Didymella sp.
tttggtcatttagaggaagtaaaagtcgtaacaaggtttccgtaggtgaacctgcggaaggatcattaccgagttttcgggcttcggctcgactctcccaccctttgtgaacgtacctctgttgctttggcggctccggccgccaaaggacctccaaactccagtcagtaaacgcagacgtctgataaacaagttaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcattacaaccctcaagctctgcttggaattgggcaccgtcctcactgcggacgcgcctcaaagacctcggcggtggctgttcagccctcaagcgtagtagaatacacctcgctttggagtggtgggcgtcgcccgccggacgaaccttctgaacttttctcaaggttgacctcggatcaggtagggatacccgctgaacttaagcatatcaata

SEQ ID NO: 1326 - DNA, 608 bp, Exserohilum rostratum
gtcgtaacaaggtctccgtaggtgaacctgcggagggatcattacacaaaagaatatgaaggctgactgcggctgcgcttcacggccagtttgctgaggctgaattattttttcacccatgtcttttgcgcacttgttgtttcctgggcgggtacgcacgccaccaggaccccaccataaacctttttatctgtagttgcaatcagcgtcagtaacaagtaaataatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtctttggctacagcccaaagactcgccttaaaacgattggcagccggcctactggtttcgcagcgcagcacatttttgcgcttgcaaccagcaaaagaggttggcaatccatcaagtcttactttctcacttttgacctcggatcaggtagggataccccgctgaacttaagcatatcaat

SEQ ID NO: 1327 - DNA, 585 bp, Lasiodiplodia pseudotheobromae
tttggtcatttagaggaagtaaaagtcgtaacaaggtctccgttggtgaaccagcggagggatcattaccgagtttacaactcccaaacccctgtgaacatacctatacgttgcctcggcggatcagcccgcgccccgtaaaacgggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaa

SEQ ID NO: 1328 - DNA, 458 bp, Curvularia sp.
tcggcggatcagcccgcgccctgtaaaacgggacggcccgcccgaggaccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaat

SEQ ID NO: 1329 - DNA, 576 bp, Fusarium equiseti
attcattacacaaaaaaatatgaaaggtgactgcagatgacctacatggccagtttgctagaggctgaattatttatcaccccatataatttgcgcacttgttgtttcctgggcgggttaaaacaaacaccaggaccacaccataaacctttttatctgtagttgcaatcagcgtcagtaacaagtaaataatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcaagcctgttcgagcgtcatttgtaccctcaagctttgcttggtgttgggcgtttttgtctttggctacagcccgaagactcgccttaaaacgattggcagccggcctactggtttcgcagcgcagcacatttttgcgcttgcaatcagcaaaagaggttggcgatccatcaagtcttactttctcacttttgacctcggatcaggtagggatacccccctgaacttaagcatatcaataa

SEQ ID NO: 1330 - DNA, 581 bp, Fusarium sp.
ccgttggtgaaaccagcggagggatcattactggggtttacgctcttcaaccctttgtgaacatacctataactgttgaaaaaaaagggtagggtctccgcgaccctcccggccaaaaaaactccgggcgggtcggcgcccgcggggaggataaccaaaactctgatttaacgacgtttcttctgagtggtacaagcaaataatcaaaacttttaacaacggatctcttggttctggcatcgatgaagaacgcagcgaaatggagaaagtaatgtgaattgcagaattcagtgaatcatcgaatctttgaacgcacattgcgcccgccagcattatggcgggcatgcctgttcgagcgtcatttcaaccctcaagctctgcttggtgttggggccctacagctgatgtaggccctcaaaggtagtggcggaccctcccggagcctcctttgcgtagtaactttacgtctcgcactgggatccggagggactcttgccgtaaaaccccccaattttccaaaggttgacctcggatcaggtaggaatacccgctgaacttaagcatatcaataagcggaggaa

SEQ ID NO: 1331 - DNA, 681 bp, Eleocharis atropurpurea
caactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtggggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatggggtgggttttaccagaagtggctagtctaaccgcaaggaggacggtcaccacggtaggattcatgactggggtgaagtcgtaacaaggtacc

SEQ ID NO: 1332 - DNA, 552 bp, Eleocharis atropurpurea
cggagctaacgcgttaagtcgaccgcctggggagtacggccgcaagattaaaactcaaaggaattgacggggacccgcacaagcggtggatgatgtggattaattcgatgcaacgcgaaaaaccttacctacccttgacatgtatggaatcctgctgagaggtgggagtgcctgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatatgtacccgggccctgtacacaccgcccgtcacacc

SEQ ID NO: 1333 - DNA, 566 bp, Acremonium strictum
tccgttggtgaaccagcggagggatcattaccagagtgccctaggctctccaacccattgtgaacttaccaaacgttccctcggcgggctcagcgcgcggtggcctccgggcctccgggcgtccgccggggaaaaccaaaccctgatttaatcgtatttctctgaggggcgaaagcccgaaaacaaaatgaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcaggcccacccttccgggggagcgggcctggtgctggggatcggcggccctcgcggcccccgtccctcaaatacagtggcggtcgcgccgcagcctcccctgcgtagtagcacaacctcgcaccggagagcggaacgaccacgccgtgaaacccccaattttttaaggttgacctcggatcaggtaggaatacccgctgaacttaa

SEQ ID NO: 1334 - DNA, 1488 bp, Alternaria teniussima
acaggtctgtgatgcccttagatgttctgggccgcacgcgcgctacactgacagagccaacgagttcttttccttgttcgaaagaattgggtaatcttgttaaactctgtcgtgctggggataaagcattgcaattattgcttttcaacgaggaatgcctagtaagcgcgtgtcatcagcatgcgttgattacgtccctgacctttgtacacaccgcccgtcgctactaccgattgaatggctcagtgaggccttcggactggctcgaggaggttggcaacgaccacctcaagccggaaagttcgtcaaactcggtcatttagaggaagtaaaagtcgtaacaaggtctccgtaggtgaacctgcggagggatcattacacaaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaataagcggaggaaaagaaaccaacagggattgccctagtaacggcgagtgaagcggcaacagctcaaatttgaaatctggctcttttagagtccgagttgtaatttgcagagggcgctttggctttggcagcggtccaagttccttggaacaggacgtcacagagggtgagaatcccgtacgtggtcgctggctattgccgtgtaaagccccttcgacgagtcgagttgtttgggaatgcagctctaaatgggaggtacatttcttctaaagctaaatattggccagagaccgatagcgcacaagtagagtgatcgaaagatgaaaagcactttggaaagagagtcaaacagcacgtgaaattgttgaaagggaagcgcttgcagccagacttgcttacagttgctcatccgggtttctacccggtgcactcttctgtaggcaggccagcatcagtttgggcggtaggataaaggtctctgtcacgtacctcctttcggggaggccttataggggagacgacatactaccagcctggactgaggtccgcgcatctgctaggatgctggcgtaatggctgtaa

SEQ ID NO: 1335 - DNA, 596 bp, Arthrinium sacchari
agtcgtaacaaggtctccgttggtgaaccagcggagggatcattacagagttatacaactcccataccatctgttaacctacccagttatgcctcggcgtaagctcggttggaggcacctgcagctaccctgtagttgcggactgccaactccagccgcggcccgccggcggtacactaaactctgttttattttatattctgagcgtcttattttaataagttaaaactttcaacaacggatctcttggttctggcatcgatgaagaacgcagcgaaatgcgataagtaatgtgaattgcagaattcagtgaatcatcgaatctttgaacgcacattgcgcccatcagtattctggtgggcatgcctgttcgagcgtcatttcaacccttaagcctagcttagtgttgggaatctgctgtactgcagttccttaaagacagtggcggagcggcggtagtcctctgagcgtagtaatttatttctcgcttttgtcaggctctgtcctcccgccataaaacccccaattttttagtggttgacctcggatcaggtaggaatacccgctgaacttaagcatatcaataagcggaggaa

SEQ ID NO: 1336 - DNA, 539 bp, Bipolaris sorokiniana
gtaggtgaacctgcggagggatcattacacaacaaaatatgaaggcctggcttcgcggccggctgaaatatttttttcacccatgtcttttgcgcacttgttgtttcctgggcgggttcgcccgccaccaggaccaaaccataaaccttttttttatgcagttgcaatcagcgtcagtaaaaacaatgtaattattacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccttcaagctttgcttggtgttgggcgttttttgtctccctctttctgggagactcgccttaaaacgattggcagccggcctactggtttcggagcgcagcacatattttgcgctttgtatcaggagaaaaggacggtaatccatcaagactctacatttttaacttttgacctcggatca

SEQ ID NO: 1337 - DNA, 1501 bp, Ceratobasidium sp.
  misc_feature 26, 29, 586, 1132, 1227, 1228, 1229, 1230, 1231, 1232, 1233, 1234, 1235, 1236, 1256, 1438: N is A,T,C or G
ttgaatgagcatggagttggttgtcnctngccccttcactggggcatgtgcacgccttctctattcatccacacacacctgtgaacttgtgagacggatagtagtcccctcggggacgagctccgtctgctatacataaactccagtaaataaatttgaatgtcatttgatgtaacgcatctataaactaagtttcaacaacggatctcttggctctcgcatcgatgaagaacgcagcgaaatgcgataagtaatgtgaattgcagaattcagtgaatcatcgaatctttgaacgcaccttgcgctccttggtattcctcggagcatgcctgtttgagtatcatgaaattctcaaaataaatcttttgtttattcaattggtttcattttggacttggaggtctgcagattcacgtctgctcctcttaaattcattagctggatctctataaacttggttccactcggcgtgataagtatcactcgctgaggacactgtaaaaggtggccaggattgtggaagaactgcttccaatattccattcacttggacaatatacttatgatctgatctcaaatcaggtangactacccgctgaacttaagcatatcaataagcggaggaaaagaaactaacaaggattcccctagtaacggcgagtgaagcgggaagagctcaaatttaaaatctggcgggttaaccgtccgagttgtagtctagagaagtatcatcgacgctggaccatgtacaagtctcttggaacagagcgtcatagagggtgagaatcccgtccttgacatggactcccagtgttttgtgttgtgctctctacgagtcgagttgtttgggaatgcagctcaaaatgggtggtaaattccatctaaagctaaatattggcgagagaccgatagcgaacaagtaccgtgagggaaagatgaaaagcactttggagagagagttaaacagtacgtgaaattgttgaaatggaaacgcttgaagtcagtcgcgttctctgggattcagccttgcttttgcttggtgcatttcctagtctacgggccagcatggattttgaccgtcggaaaagggctgggggaatgtggcacttcgggtgtgttatagccccttgtngcatgcgtcggttgggatcgaggacctcagtgcacgcttcggttgtgctttgatgctggcgtaatggctttaaacgacccgtcttgaaacacggnnnnnnnnnncagtcaacttctgctatgtntgggtgcaaaaccgagcgcgaaatgaaagtgataagttgggaacctcattagaggggcaccgacgcccggaccagaccttctgtgacggatccgaggtagagcatatatgttgggacccgaaagatggtgaactatgcctgcatagggtgaagccagaggaaactctggtggaggctcgtancgattctgacgtgcaaatcgatcgtcaaatgtgggtataggggcgaaagactaatcgaaccat

SEQ ID NO: 1338 - DNA, 718 bp, Chaetomium funicola
ggattcggaataatttcacatattattagccaagaaagaggtaaaaaggaggcatttggtgtcttaggaataatttatgccataatagctattggacttttaggttttgtagtatgggctcatcatatatttacagtaggaatagatgtagacacccgtgcttattttacttcagccactataattattgctgtacccactggtattaaaatttttagatgattagcaacctatcatggagcccaaattaatttaactccatcctcattatgagctattggttttattttccttttcacgatgggaggcttaaccggagtaatcctagctaattcttctattgatattattcttcatgatacttattatgtagtagctcattttcactatgttttatcaataggagcagtatttgctattctagcaggaattattcaatgattcccactattcacagggcttacccttaataataaatacttaaaaatccagtttgtaactatatttattggagtaaatttaaccttcttcccccaacattttttaggactaagaggcataccacgacgatactctgactatcctgacgcatattttatatgaaatattgtatcctcaatcggaagaataatctctctagtaagagtaatttattttatatttattatttgagaggctttttcagttaaacgtataaatctttcatctttaaatttat

SEQ ID NO: 1339 - DNA, 875 bp, Chaetomium globulosum
ttgttgaaagttttaactttttatagtttatgccactcagcaatgaaatcaaatttctagtaaaaaaaataaaagagttttagtggtaagactatgctgccggcagcttagagtttgccccccttcttccctttttaacaggaaacggggctcaaaaccaccaaagcagcgttcgtcttatagaagaagggtatgttcacacatggtttgtagagtacaaaaactcagtaatgatccctccgtaggtggacctgcggagggatcattactgagtttttgtactctacaaaccatgtgtgaacatacccttcttctataagacgaacgctgctttggtggttttgagccccgtttcctgttaaaaagggaagaaggggggcaaactctaagctgccggcagcatagtcttaccactaaaactcttttattttttttactagaaatttgatttcattgctgagtggcataaactataaaaagttaaaactttcaacaacggatctcttggctctagcatcgatgaagaacgcagcgaaatgcgataagtaatgtgaattgcagaattcagtgaatcatcgaatctttgaacgcacattgcgcctggcagtattctgccaggcatgcctgtccgagcgtcatttcaccactcaagaaatacttttttttttttcttggtgttggaggtcctgttctttactgagcaggccgccgaaatgtatcggctgttatacttgccaactcccctgtgtagtactaaaatttattttttcacactttgaagttcctgtgtaacatgccgttaaaccctcaatatccaacttctgttgaattattattatttttttacaaggttgacctcggatcaggtaggaata

SEQ ID NO: 1340 - DNA, 524 bp, Cladosporium cladosporioides
tccgtaggtgaacctgcggagggatcattacaagaaacgaccccggttttaccaccgggtgatttcataaccctttgttgtccgactctgttgcctccggggcgaccctgccttcgggcgggggctccgggtggacaaattcaaactcttgcgtaactttgcagtctgagtaaatttaattaataaattaaaactttcaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcgacgcggtccgccgcgcgcctcaaatcgaccggctgggtcttctgtcccctaagcgttgtggaaactattcgctaaagggtgctcgggaggctacgccgtaaaacaaccccatttctaaggttgacctcggatcaggtagggatacc

SEQ ID NO: 1341 - DNA, 568 bp, Cladosporium herbarum
aaaagtcgtaacaaggtctccgtaggtgaacctgcggagggatcattacaagaacgcccgggcttcggcctggttattcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgtccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataagcggagga

SEQ ID NO: 1342 - DNA, 590 bp, Cladosporium minourae
ttggtcaaacccggtcatttagaggaagtaaaagtcgtaacaaggtctccgtaggtgaacctgcggagggatcattacaagaacgcccgggcttcggcctggttattcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgtccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataac

SEQ ID NO: 1343 - DNA, 528 bp, Cordyceps cylindrica
cctgcggaaggatcattacagtgttccctgccctcacgggtagaaacgcccacccttgtataatatatcttgttgctttggcaggccgccctcgggtaccggcttcggctgggttcgcgcctgccagaggaccccaaactctgaatgttagtgtcgtctgagtactatataatagttaaaactttcaacaacggatctcttggttctggcatcgatgaagaacgcagcgaaatgcgataagtaatgtgaattgcagaattcagtgaatcatcgaatctttgaacgcacattgcgccccgtggtattccgcggggcatgcctgttcgagcgtcatttaaaccaatccagcttgctgggtcttgggcttcgcctccgggcgggcctcaaaatcagtggcggcgccacccggctctaagcgtagtaatacttctcgctacagagtcccgggtggaggctggccaacaacccccaatttttacaggttgacctcggatcaggtagggatacccgctgaacttaagcatatca

SEQ ID NO: 1344 - DNA, 563 bp, Epicoccum nigrum
aaaagtcgtaacaaggtttccgtaggtgaacctgcggaaggatcattacctagagtttgtagacttcggtctgctacctcttacccatgtcttttgagtaccttcgtttcctcggcgggtccgcccgccgattggacaacattcaaaccctttgcagttgcaatcagcgtctgaaaaaacataatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgtgtagactcgccttaaaacaattggcagccggcgtattgatttcggagcgcagtacatctcgcgctttgcactcataacgacgacgtccaaaagtacatttttacactcttgacctcggatcaggtagggatacccgctgaacttaagcatatcaataagcggaggaa

SEQ ID NO: 1345 - DNA, 646 bp, Fusarium avenaceum
tcgtcgtcatcggccacgtcgactctggcaagtcgaccactgtaagtacaaccatcagcgagtcgcttatctgcactcggaacccgccaaacctggcggggtatcaccacgacatcttgctaactcttgacagaccggtcacttgatctaccagtgcggtggtatcgacaagcgaaccatcgagaagttcgagaaggttagtcaatatcccttcgattacgcgcgctcccatcgattcccacgactcgctccctcattcgaaacgcattcattaccccgctcaagtccgaaaattttgcggtgcgaccgtgattttttttggtggggtatcttaccccgccactcgagtgacggatgcgcttgccctgttcccacaaaaccttaccacactgtcgcgcactatgtcttgcagtcactaaccactggacaataggaagccgccgagctcggaaagggttccttcaagtacgcctgggttcttgacaagctcaaagccgagcgtgagcgtggtatcaccattgatatcgctctctggaagttcgagactcctcgctactatgtcaccgtcattggtatgttgtcactgtctcacaccaccatgccttcatcatgctaacattcctctcagatgcccccggtcatcgtg

SEQ ID NO: 1346 - DNA, 650 bp, Fusarium flocciferum
tcgtcgtcatcggccacgtcgactctggcaagtcgaccactgtaagtacaaccatcagcgagtcgcttatctgcactcagagcctgccaaacctggcggggtattaccacaacagtttgctaacttttgatagaccggtcacttgatctaccagtgcggtggtatcgacaagcgaaccatcgagaagttcgagaaggttagtcaatatcccttcgattgcgcgctcccatcgatccccacgactcgctccttcactcgaaacgcatccattaccccgctcgagcccgaaaattttgcggtgcgaccgtgatttttttttggtggggtatcttaccccgccactcgagtgacggatgcgcttgccctgttcccacaaaaccttactaccctgccgcgcactatcatatgtcttgcagtcactaaccactggacaataggaagccgccgagctcggaaagggttccttcaagtacgcctgggttcttgacaagctcaaagccgagcgtgagcgtggtatcaccattgatatcgctctctggaagttcgagactcctcgctactatgtcaccgtcattggtatgttgtcactgtctcataccaccatgctttcatcatgctaacatccctctcagatgcccccggtcatcgtg

SEQ ID NO: 1347 - DNA, 693 bp, Fusarium poae
  misc_feature 558: N is A,T,C or G
ctaacataggaaaaactacagtatactaaaatctctttcttccccccaccattctatatgggtaaggtcaagttgaaactaacattggacatagtcttgaaaagacacacacacacacacacacacacacacacacacaagcatacagagaaaagccacaaagtttcacgaaatctacaaggcatggcacttttagtttgctcctcctagttaactcttcaatcttctgtaacatgtctttttgctctgggaagaggacctgcatagaaaatatcacagagccccttgtcttttgccctttggtttggtcaagccaactcagagccccagcaggatataagagagaatgttgggcagagtgataaagtggtagtgggtatatttattctccaactccctttatgagaaatcaccttagattagcaggaccttccagcctaactaaaggtcacaatttgtctctaggtggtccctctctccaagcctcttctgatttatagaaaccactcccctccttagggtaccgagctcgaattcgtaatcatggtccatagctgnttcctgtgtgaaattgttatccgctcacaattccacacaacatacgagccggaagcataaagtgtaaagccctggggtgcctaatgagtgagctaactcacattaattgcgttgcgctcactgccccgctttcca

SEQ ID NO: 1348 - DNA, 407 bp, Fusarium reticulatum
  misc_feature 278, 284, 285, 292, 302, 312, 319, 326, 340, 342, 344, 372: N is A,T,C or G
ctttgcgcccctgattctaccccgctgggtggtagcagctcaacaacaatgcacgacagctcgcagcttgagcttgatcaacaaccttgtgctggaacatgagactaaccatatcttttctttgcaataggttcatcttcagaccggtcagtgcgtaagtactcgttgctccaacgtcatccatgagggatgctaacaatgttgattagggtaaccaaattggtgctgctttctggcagactatctctggcgagcatggtcttgacagcaatggtgtntacaanngcacctnggagcttcanctcgagcgcntgagcgnctacttnaacgaggtatgttncngncagttaattccaagaaaactgtaggctnacgcaaataggcttccggcaacaagtacgtccctc

SEQ ID NO: 1349 - DNA, 646 bp, Fusarium sporotrichioides
tcgtcgtcatcggccacgtcgactctggcaagtcgaccactgtgagtacatctgcatcacaaccccgcccagacttggcggggtagtttcaatcatcatttttactgacatgctttgacagaccggtcacttgatctaccagtgcggtggtatcgacaagcgaaccatcgagaagttcgagaaggttggtctcattttcctcgatcgcgcgcccttcttcccatcgacccatcattcgaatcgctctcatacgacgactcgacaagcgcctgttaccccgctcgagttcaaaatttttacggctgtgtcgtgattttttttgatagtggggctcataccccgccgctcgagtgacaggcgcttttgcccttcccacacatccatttacatgggcgcgcatcatcacgtgtcaatcagtcactaaccacctgtcaataggaagccgccgagctcggtaagggttccttcaagtacgcctgggttcttgacaagctcaaagccgagcgtgagcgtggtatcaccattgatatcgctctctggaagttcgagactcctcgctactatgtcaccgtcattggtatgttgtcactattgccttcatcacattctcatactaacatgcctaccagacgctcccggtcaccgt

SEQ ID NO: 1350 - DNA, 652 bp, Fusarium torulosum
tcgtcgtcatcggccacgtcgactctggcaagtcgaccactgtaagtacaaccatcagcgagttgcttacctgcactcggagtctgccaaacctggcggggtattatcacaacattttgctaacttttgacagaccggtcacttgatctaccagtgcggtggtatcgacaagcgaaccatcgagaagttcgagaaggttagtcaaaatcccttcgattgcgcgcgctcccatcgattcctacgactcgctccctcactcgaaacgcatccattaccccgctcgagcccgaaaattttgcggtgcgaccgtgatttttttttggtggggtatcttaccccgccactcgagtgacggatgcgcttgccctgttcccacaaaaccttactaccctgtcgcgcactatcatatgtcttccagtcactaaccactggacaataggaagccgccgagctcggaaagggttccttcaagtacgcctgggttcttgacaagctcaaagccgagcgtgagcgtggtatcaccattgatatcgctctctggaagttcgagactcctcgctactatgtcaccgtcattggtatgttgtcactgtctcataccaccatgctttcaccatgctaacatctctctcagatgcccccggtcatcgtg

SEQ ID NO: 1351 - DNA, 649 bp, Fusarium tricinctum
tcgtcgtcatcggccacgtcgactctggcaagtcgaccactgtaagtacaaccatcagcgggttgcttatatgcactcggaatccgccaaacctggcggggtatcaccacaacattttgctaacttttgacagaccggtcacttgatctaccagtgcggtggtatcgacaagcgaaccatcgagaagttcgagaaggttagtcaatatcccttcgattacgcgcgctcccatcgattcccacgattcgctccctcactcgaaacgcatccattaccccgctcgagcccgagaattttgcggtgcgaccgtgatttttttctggtggggtatcttaccccgccactcgagtgacggatgcgcttgccctgttcccacaaaaccttaccaccctgtcgcgcactacatgtcttgcagtcactaaccactggacaataggaagccgccgagctcggaaagggttccttcaagtacgcctgggttcttgacaagctcaaagccgagcgtgagcgtggtatcaccattgatatcgctctctggaagttcgagactcctcgctactatgtcaccgtcattggtatgttgtcactgtctcacactatcatgcttgcatcatgctaacatctctgtcagatgcccccggtcatcgtg

SEQ ID NO: 1352 - DNA, 566 bp, Geomyces pannorum
tccgtaggtgaacctgcggaaggatcattacagtagtcacccaggttgccgcaaggcctcctgggtaacctaccaccctttgtttattacactttgttgctttggcaagcctgccctcgggctgctggctccggccggcgagcgcttgccagaggacctaaactctgtttgtctatactgtctgagtactatataatagttaaaactttcaacaacggatctcttggttctggcatcgatgaagaacgcagcgaaatgcgataagtaatgtgaattgcagaattcagtgaatcatcgaatctttgaacgcacattgcgccccctggtattccggggggcatgcctgtccgagcgtcattacaaccctcaagctcagcttggtattgggccccgccgacccggcgggccctaaagtcagtggcggtgccgtccggctccgagcgtagtaattcttctcgctctggaggtccggtcgtgtgctcgccagcaacccccaatttttttcaggttgacctcggatcaggtagggatacccgctgaacttaagcatatcaataagcggagga

SEQ ID NO: 1353 - DNA, 571 bp, Gibberella avenacea
aaagtcgtaacaaggtctccgttggtgaaccagcggagggatcattaccgagtttacaactcccaaacccctgtgaacataccttaatgttgcctcggcggatcagcccgcgccccgtaaaacgggacggcccgccagaggacccaaactctaatgtttcttattgtaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgctggtattccggcgggcatgcctgttcgagcgtcatttcaaccctcaagcccccgggtttggtgttggggatcggctctgccttctggcggtgccgcccccgaaatacattggcggtctcgctgcagcctccattgcgtagtagctaacacctcgcaactggaacgcggcgcggccatgccgtaaaaccccaacttctgaatgttgacctcggatcaggtaggaatacccgctgaacttaagcatatcaataag

SEQ ID NO: 1354 - DNA, 625 bp, Hypocrea sp.
tataagtcgtaacaaggtctccgttggtgaaccagcggagggatcattaccgagtttacaactcccaaacccctatgtgaacgttaccaaactgttgcctcggcgggaaattcatgccccgggcgcgtcgcagccccggaccaaggcgcccgccggaggaccaaccaaaactcttttgtatgtccctcgcggacttttataattctgaaccatctcggcgcccctagcgggcgtttcgaaaatgaatcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgtccgagcgtcatttcaaccctcgaacccctccgggggtccggcgttggggatcggcccttaccggccggccccgaaatacagtggcggtctcgccgcagcctctcttgcgcagtagtttgcacactcgcatcgggagcgcggcgcgtccacgtccgtaaaacacccaacttctgaaatgttgacctcggatcaggtaggaatacccgctgaacttaagcatatcaataagcg

SEQ ID NO: 1355 - DNA, 537 bp, Macrophoma sp.
cattaccaatatgaaagcggatggggagccacagaagctagagtcctcgtggctctgtttctgccctatctgtctgaatattcacccatgtcttttgcgtaccaattgtttccttggtgggccatcccgccaacaggacattgttaaaccttttgtaattgcagtcagcgtcagaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccctcaagctctgcttggtgttgggcgtttgtctcccctgggagactcgcctcaaaacaattggcagccggcatattggtatcggagcgcagcacaagtcgcgcttctgtccatgaatgttggcatccagcaagaccatttttcactcttgacctcggatcaggtagggatacccgctgaacttaa

SEQ ID NO: 1356 - DNA, 555 bp, Microdochium bolleyi
tccgtaggtgaacctgcggagggatcattactgagtttttaactctccaaaccatgtgaacttaccactgttgcctcggtggtcggtgctggaaacagtgctgccaccggtggactactaaactcttgttaatttttgtcaaatctgaatcaaactaagaaataagttaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagcctagcttagtgttgggagactgcctaatacgcagctcctcaaaaccagtggcggagtctgttcgtgctctgagcgtagtaattttttatctcgcttctgcaagccggccagacgacagccataaaccgcaccctctcggggggcacttttttaatggttgacctcggatcaggtaggaatacccgctgaacttaagcatatcaataagcggaggaa

SEQ ID NO: 1357 - DNA, 634 bp, Mortierella hyalina
tttccgtaggtgaacctgcggaaggatcattcataataagtgttttatggcacttttttaaatccatatccaccttgtgtgcaatgtcagggttggtttctctcttttgagagatcaaccccaaacatcaactctatcttaactctttgtctgaaaaatattatgaataaaacaattcaaaatacaactttcaacaccggatctcttggctctcgcatcgatgaagaacgcagcgaaatgcgatacgtaatgtgaattgcagaattcagtgaatcatcgaatctttgaacgcatattgcgctctttggtattccgaagagcatgcttgtttgagtatcagtaaacacctcaaagccttttttcttttttgaagaaaggctttggacttgagcaatcccaacaccaatcttttaaagagagggggggggttgcttgaaatgcaggtgcagctggacattctcctgagctaaaagcatattcatttagtcccgtcaaacggattattacttttgctgcagctaatataaagggagtttgaccattttggctgactgatgcaggattttcacaagagtcttcaaaacctcttgttaaactcgatctcaaatcaagtaagactacccgctgaacttaa

SEQ ID NO: 1358 - DNA, 557 bp, Nigrospora oryzae
tctcgttggtgaccagcggagggatcattacagagttatccaactcccaaacccatgtgaacttatctctttgttgcctcggcgcaagctacccgggacccagcgccccgggcggcccgccggcggacaaaccaaactcttgttatcttagttgattatctgagcgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttactgttgggactctacggcctccgtagttccctaatgcgattggcggagtggcagtagtcctctgagcgtagtaattctttatctcgcttttgttaggtgctgcccccccggccgttaaacccccaattttttctggttgacctcggatcaggtaggaatacccgctgaacttaagcatatcaataggssggaggaa

SEQ ID NO: 1359 - DNA, 528 bp, Nectria sp.
gtttacaactcccaaacccctgtgaacatacctatcgttgcttcggcggatccgccccggtgccttcgggcccggactcaggcgcccgccgggggacccaaactcttgtatttctttagtatcttctgagtaaacaagcaaataaattaaaactttcaacaacggatctcttggttctggcatcgatgaagaacgcagcgaaatgcgataagtaatgtgaattgcagaattccgtgaatcatcgaatctttgaacgcacattgcgcccgccagtattctggcgggcatgcctgttcgagcgtcatttcaaccctcaagcccccgggcttggtgttggggctcggcccgtccctagcggcgcgccgtccccgaaatctagtggcggtcacgctgtactcctctgcgtagtaatctaacctcgcaacgggacaaagcgcggccacgccgttaaacccccaacttctgaaggttgacctcggatcaggtaggaatacccgctgaacttaagcatatcaataagcggaggac

SEQ ID NO: 1360 - DNA, 638 bp, Ophiosphaerella sp.
ggctcagtgaggccttcggactggcttggggaggttggcaacgaccaccctaagccggaaagttcgtcaaactcggtcatttagaggaagtaaaagtcgtaacaaggtttccgtaggtgaacctgcggaaggatcattaaatgatagtactggccctaaggtgtggtaatacatgccggtgggcttcacgtctattacccttgtttttcgagtacctatgtttccttggtgggcttgcccaccaattggacaccctattaaacctttttaatttttaattagcgtctgaataaacttaataattacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccctcaagctatgcttggtgttgggtgtttgtcctctccattgcgtttggactcgccttaaagcaattggcagccagtgttttggttttaagcgcagcacattttgcgtcttactcccttgaatactagcatccattaagcctttttatcacttttgacctcggatcaggta

SEQ ID NO: 1361 - DNA, 524 bp, Oidiodendron cerealis
cattacagagttcatgccctagcgggtagatctcccacccactgttattgttactgtcgttgctttggcgggccgccgggcccagctcggccgccggctccggctggcgcgcgcccgccagaggccttcaaactctgaatgttagtgtcgtctgagtactatacaatagttaaaactttcaacaacggatctcttggttctggcatcgatgaagaacgcagcgaaatgcgataagtaatgcgaattgcagaattcagtgagtcatcgaatctttgaacgcacattgcgccctgtggtattccgcagggcatgcctgttcgagcgtcatttcaaccctcaagctctgcttggtgttgggccacgcccccgcggccggccccaaagctagtggcggtgccgtctggctctaagcgtagtacatctctcgctctagggcccggcggttgcttgccagaacccacactcttatggttgacctcggatcaggtagggatacccgctgaacttaagcatatcaataagcg

SEQ ID NO: 1362 - DNA, 610 bp, Penicillium aurantiogriseum
ggaagtaaaagtcgtaacaaggtttccgtaggtgaacctgcggaaggatcattaccgagtgagggccctttgggtccaacctcccacccgtgtttattttaccttgttgcttcggcgggcccgcctttactggccgccggggggcttcacgcccccgggcccgcgcccgccgaagacaccctcgaactctgtctgaagattgaagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcccggcttgtgtgttgggccccgtcctccgattccgggggacgggcccgaaaggcagcggcggcaccgcgtccggtcctcgagcgtatggggctttgtcacccgctccgtaggcccggccggcgcttgccgatcaacccaaatttttatccaggttgacctcggatcaggtagggatacccgctgaacttaagcatatcaataagcggagga

SEQ ID NO: 1363 - DNA, 585 bp, Penicillium commune
cgtaggtgaacctgcggaaggatcattaccgagtgagggccctctgggtccaacctcccacccgtgtttattttaccttgttgcttcggcgggcccgccttaactggccgccggggggctcacgcccccgggcccgcgcccgccgaagacaccctcgaactctgtctgaagattgaagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcccggcttgtgtgttgggccccgtcctccgatttccgggggacgggcccgaaaggcagcggcggcaccgcgtccggtcctcgagcgtatggggctttgtcacccgctctgtaggcccggccggcgcttgccgatcaacccaaatttttatccaggttgacctcggatcaggtagggatacccgctgaacttaagcatatcaataagcggaggaa

SEQ ID NO: 1364 - DNA, 1384 bp, Penicillium griseofulvum
cagcgagtacatcaccttaaccgagaggtttgggtaatcttgttaaaccctgtcgtgctggggatagagcattgcaattattgctcttcaacgaggaatgcctagtaggcacgagtcatcagctcgtgccgattacgtccctgccctttgtacacaccgcccgtcgctactaccgattgaatggctcagtgaggccttgggattggcttaggagggttggcaacgaccccccagagccgaaaacttggtcaaactcggtcatttagaggaagtaaaagtcgtaacaaggtttccgtaggtgaacctgcggaaggatcattactgagtgagggccctctgggtccaacctcccacccgtgtttatttaccttgttgcttcggcgggcccgccttaactggccgccggggggcttacgcccccgggcccgcgcccgccgaagacaccctcgaactctgtctgaagattgtagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcacggcttgtgtgttgggccccgtcctccgattccgggggacgggcccgaaaggcagcggcggcaccgcgtccggtcctcgagcgtatggggctttgtcacccgctctgtaggcccggccggcgcttgccgatcaacccaaatttttatccaggttgacctcggatcaggtagggatacccgctgaacttaagcatatcaataagcggaggaaaagaaaccaacagggattgccccagtaacggcgagtgaagcggcaagagctcaaatttgaaagctggctccttcggggtccgcattgtaatttgtagaggatgcttcgggagcggtccccatctaagtgccctggaacgggacgtcatagagggtgagaatcccgtatgggatggggtgtccgcgcccgtgtgaagctccttcgacgagtcgagttgtttgggaatgcagctctaaatgggtggtaaatttcatctaaagctaaatattggccggagaccgatagcgcacaagtagagtgatcgaaagatgaaaagcactttgaaaagagagttaaaaagcacgtgaaattgttgaaagggaagcgcttgcgaccagactcgctcgcggggttcagccggcattcgtgccggtgtacttccccgcgggcgggccagcgtcggtttgggcggtcggtcaaaggccctcggaaggtaacgcccctaggggcgtcttatagccgagggtgc

SEQ ID NO: 1365 - DNA, 610 bp, Penicillium solitum
tccgtaggtgaacctgcggaaggatcattaccgagtgagggccctctgggtccaacctcccacccgtgtttattttaccttgttgcttcggcgggcccgccttaactggccgccggggggctcacgcccccgggcccgcgcccgccgaagacaccctcgaactctgtctgaagattgaagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcccggcttgtgtgttgggccccgtcctccgatttccgggggacgggcccgaaaggcagcggcggcaccgcgtccggtcctcgagcgtatggggctttgtcacccgctctgtaggcccggccggcgcttgccgatcaacccaaatttttatccaggttgacctcggatcaggtagggatacccgctgaacttaagcatatcaataagcggaggaaaagaaaccaacagggattgcccc

SEQ ID NO: 1366 - DNA, 609 bp, Penicillium tricolor
tccgtaggtgaacctgcggaaggatcattaccgagtgagggccctttgggtccaacctcccacccgtgtttattttaccttgttgcttcggcgggcccgcctttactggccgccggggggctcacgcccccgggcccgcgcccgccgaagacacctccgaactctgtctgaagattgaagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcccggcttgtgtgttgggccccgtcctccgattccgggggacgggcccgaaaggcagcggcggcaccgcgtccggtcctcgagcgtatggggctttgtcacccgctctgtaggcccggccggcgcttgccgatcaacccaaatttttatccaggttgacctcggatcaggtagggatacccgctgaacttaagcatatcaataagcggaggaaaagaaaccaacagggattgcccc

SEQ ID NO: 1367 - DNA, 634 bp, Periconia macrospinosa
atggctcagtgaggccttcggactggctcgaggaggttggcaacgaccaccccgagccggaaagttggtcaaactcggtcatttagaggaagtaaaagtcgtaacaaggtttccgtaggtgaacctgcggaaggatcattacacattcggggcgcttcggcgctccttatacacccaccctctgcctacgtgtacctctatagcttcctcggcgggctcgcccgccgccaggaacccacgaaaccccttgcattatacgcgaaaacttctgataacaaacctaaattatcacaactttcaacaatggatctcttggttctggcatcgatgaagaacgcagcgaaatgcgataagtagtgtgaattgcagaattcagtgaatcatcgaatctttgaacgcacattgcggccataggtattcctttggccatgcctgttcgagcgtcatttacaccctcaagcctagcttggtgttgggcgtctgtcccgccgttctcgcgcgcggactcgcctcaaagtcattggcggcggtcgtgccggccccctcgcgcagcacatttgcgcttctcggaggcccggcggatccgcgctccagcaagacctttcacgacttgacctcggatacaggtagggat

SEQ ID NO: 1368 - DNA, 585 bp, Phaeosphaeria avenaria
tccgtaggtgaacctgcggaaggatcattacactcagtagtttactactgtaaaggaggctgttagtctgtatagcgcaagctgatgagcagctagcctcttttatccacccttgtcttttgcgtacccacgtttcctcggcaggcttgcctgccgattggacaaacctataacctttttaattttcaatcagcgtctgaaaaacttaataattacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccctcaagctctgcttggtgttgggtgtttgtcctctccctagtgtttggactcgccttaaaataattggcagccagtgttttggtattgaagcgcagcacaagtcgcgattcttatcaaatacttgcgtccacaagcccttttttaacttttgacctcggatcaggtagggatacccgctgaacttaagcatatcaataagcggagga

SEQ ID NO: 1369 - DNA, 523 bp, Preussia africana
  misc_feature 3: N is A,T,C or G
aangaagtaaaagtcgtaacaaggtttccgtaggtgaacctgcggaaggatcattatcgtagggcttcggccctgtcgagatagaacccttgcctttttgagtacctttcgtttcctcggcaggctcgcctgccaatggggaccacaaaaaacactttgcagtacctgtaatagtctgaacaaacaaacaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgttgggtgactgtccgcttcactgcggactcgcctcaaaattattggcggccggtacattggcttcgagcgcagcagaaacgcgaactcgggcccgtcgtattggctcccagaagctatcttcacaatttgacctcggatcaggta

SEQ ID NO: 1370 - DNA, 528 bp, Preussia minima
gaacctgcggaaggatcattatcgttgggcttcggcccattcgagataatacccttgcctttttgagtaccttttcgtttcctcggcaggctcgcctgccaacggggacccttcaaaacgccttgtaatacctgtaattgtctgatataacaagcaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgatgggtgactgtcccccccttcgcggggggactcgcctcaaaaacattggcggccggtacattggcttcgagcgcagcagaaacgcggtctcgagcccggtggatcgtctcccataagctccttctttattttgacctcggatcaggtagggatacccgctgaacttaagcatatcaataagcg

SEQ ID NO: 1371 - DNA, 350 bp, Pyrenomataceae sp.
gcatcgatgaagaacgcagcgaaatgcgataagtagtgtgaattgcagaattcagtgaatcatcgaatctttgaacgcacattgcgcctcctggtattccgggaggcatgcctgttcgagcgtcattaaaatcactcaagcttaggtttacctattgcttggtcttggagatggaagccaattcattggaatcctcttcgaaattcaatggcgaagacccttgctctcccaagtgtagtaataacttatgtcactgaaggaagcgagaaatcttctgccgtaacccccatattttctatgattgacctcggatcaggtagggatacccgctgaacttaagcatatcaata

SEQ ID NO: 1372 - DNA, 545 bp, Pyrenophora teres
ggatcattacacaaatatgaaggcagattgggtagtccccgcttttgggggtttgcccattctggcgccatattcacccatgtcttttgcgtactacttgtttccttggcgggctcgcccgccaattggactttattcaaacctttttttattgcaatcagcgtcagcaaaacaatgtaatcaattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttttgtctctcccccgagactcgccttaaaaacattggcagccggcctactggtttcggagcgcagcacattatttgcgctcttgtccagccgcggtcgcgcgtccatgaagccttttttttttaaccttttgacctcggatcaggtagggatacccgctgaacttaa

SEQ ID NO: 1373 - DNA, 547 bp, Pyrenophora triticirepentis
ccgtaggtgaacctgcggagggatcattacacaaatatgaagccggactgggatagggcctcgctgccttgcccgtctggcgccatattcacccatgtctttttgcgtactacttgtttccttggcgggtccgcccgccaattggaccttattcaaaccttttttttcagttgcaatcagcgtcagcaaaacaaatgtaatcaattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctctcccgagactcgccttaaaatcattggcagccggcctactggtttcggagcgcagcacattatttgcgctcttgtccagccgcggtcgcgcgtccatgaagcttctttcaaccttttgacctcggatcaggtagggatacc

SEQ ID NO: 1374 - DNA, 563 bp, Pyronema domesticum
taacaaggtttccgtaggtgaacctgcggaaggatcattaaaagttaattggttatactccggtataaatctaattaaacacctctgagtaccttacctgttgcttccgtgaggcctgactccagtagtggttcgccaccactggatacttgcggaaggtatacacttaaacactttgaatctatgtcatctgtctgataatgtttataacaaacgttaaaactttcaacaacggatctcttggttctcgcatcgatgaagaacgcagcgaaatgcgataagtagtgtgaattgcagaattcagtgaatcatcgaatctttgaacgcacattgcgcctcctggtattccgggaggcatgcctgttcgagcgtcattaaaacctcctcaagctcttttgcttggtattggaagaagaggccgcttgtcggtctccctttcgaaatgcaatggcagattgcctcatgtgccctggcgtaataagatttatctttcgcttgtgcattgggatgatcccgccgcaaacccccaattttttctggttgacctcggatcaggtagggat

SEQ ID NO: 1375 - DNA, 537 bp, Thielavia hyalocarpa
gagggatcattacagagttgcaaaactccctaaaccattgtgaacgttaccttcaaaccgttgcttcggcgggcggcaccgggcccgcccggtgccccctggccccccccagcggggcgcccgccggaggaaacccaactcttgatacattatggcctctctgagtcttctgtactgaataagtcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgttcgagcgtcatttcaaccatcaagcccccgggcttgtgctggggacctgcggctgccgcaggccctgaaaaccagtggcgggctcgctgtcacaccgggcgtagtagattttatctcgctcagggcgtgctgcgggctccggccgttaaaaagcctttttcacccaaggttgacctcggatcaggtaggaagacccgctgaactta

SEQ ID NO: 1376 - DNA, 635 bp, Trichoderma harzianum
tagaagtcgtaacaaggtctccgttggtgaaccagcggagggatcattaccgagtttacaactcccaaacccaatgtgaacgttaccaaactgttgcctcggcgggatctctgccccgggtgcgtcgcagccccggaccaaggcgcccgccggaggaccaacctaaaactcttattgtataccccctcgcgggtttttttataatctgagcctttctcggcgcctctcgtaggcgtttcgaaaatgaatcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgtccgagcgtcatttcaaccctcgaacccctccggggggtcggcgttggggatcggccctcccttagcgggtggccgtctccgaaatacagtggcggtctcgccgcagcctctcctgcgcagtagtttgcacactcgcatcgggagcgcggcgcgtccacagccgttaaacacccaacttctgaaatgttgacctcggatcaggtaggaatacccgctgaacttaagcatatcaataagcg

SEQ ID NO: 1377 - DNA, 225 bp, Acremonium alternatum
gggtacataaactcccaaaccattgtgaacttaccactgttgcttcggcggcctcgccccgggcgcgttcgcgcggcccggacccaggcgtccgccggaggctccaaactcttgtcttttagtgtatttctgagtggcataagcaaataaatcaaaactttcagcaacggatctcttggttctggcatcgatgaagaacgcagcaggactaacgtgtgtcgacgg

SEQ ID NO: 1378 - DNA, 225 bp, Alternaria alternata
gccaatgaacacctgcggagggatcattacacaaatatgaaggcgggctggacctctcggggttacagccttgctgaataatcccccttgtcttttgcgtacttcttgtttccttggtgggttcgcccaccactaggacaaacataaaccttttgtaattgcaatcagcgtcagtaacaaattaataattacaactttcaacaacggatctcttggttctggcat

SEQ ID NO: 1379 - DNA, 240 bp, Alternaria brassicae
gactttcatagtaggaggagcgggctggaatcaccctctcggggggtacagccttgctgaattatttcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcacagtcagtgtgaaatc

SEQ ID NO: 1380 - DNA, 224 bp, Alternaria compacta
tgcgtatgtccgacatatcaggcgggctggacctctcggggttacagccttgctgaattattcaccccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaaaaacgcatcaa

SEQ ID NO: 1381 - DNA, 297 bp, Alternaria dianthi
cctccggactggctcgaggaggttggcaacgaccacctcaagccggaaagttggtcaaactcggtcatttagaggaagtaaaagtcgtaacaatttctccgtaggtgaacctgcggagggatcattacacaggtatgaaggcgggctggaatctctcggggttacagccttgctgaattattcacccgtgtcttttgcgtacttcttgtttcctgggtgggttcgcccaccaccaggaccaaccataaaccttttgtaattgcaatcagcgtcagtaacaaaataataattacaact

SEQ ID NO: 1382 - DNA, 249 bp, Alternaria longipes
tggtaattacaaaatgaagcgggctggacctctcggggttacagcctgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcaaattaatgccggctggaacgcctctgggata

SEQ ID NO: 1383 - DNA, 227 bp, Alternaria mali
atcgtggaggtcaggactattacacatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttccacaacgggatctcttgggttctggcatcgctagc

SEQ ID NO: 1384 - DNA, 210 bp, Alternaria sesami
aggcgggctggcacctctcggggtggccagccttgctgaattattccacccgtgtcttttgcgtacttcttgtttccttggtgggctcgcccaccacaaggaccaacccataaacctttttgtaatggcaatcagcgtcagtaacaatgtaataattacaactttcaacaacggatctcttggttctggcatcgatgaagaacgcagcaa

SEQ ID NO: 1385 - DNA, 256 bp, Alternaria solani
atgtgtcatggtatgaggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtaat

SEQ ID NO: 1386 - DNA, 263 bp, Alternaria sp.
aggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagctaaatacatatgaaggcgggctggaacgtcccgcggttgcagacttgctgacttattcacc

SEQ ID NO: 1387 - DNA, 204 bp, Alternaria tenuissima
tgaggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagc

SEQ ID NO: 1388 - DNA, 293 bp, Ascomycota sp.
cccctaaggtcggggagtccccgcccatgagcgctttaacgggtgtgctgcggccactggagtgttggccgtctcgccgggtctcggaaagcacggggagaatccgcgtgcttacgtggggtgtgtcgaatacggacccgggatggcgtgccggcaagtgcccttcgggaggcacaagctcctgtgaagatgggcattcgccctttacgcagcacatgactgaatccttattctactcgtacctcttgttctccttcggtggggcaacctgccgttggaacctttatacaacc

SEQ ID NO: 1389 - DNA, 244 bp, Bipolaris spicifera
acgaaggccgttcgcggctggactatttattacccttgtcttttgcgcacttgttgtttcctgggcgggttcgctcgccaccaggaccacaatataaaccttttttatgcagttgcaatcagcgtcagtataacaaatgtaaatcatttacaactttcaacaacggatctcttggttctggcatcgatgaagaacgcagcaatacacactcaataaaaaacgaaggccgttcgcggacggacta

SEQ ID NO: 1390 - DNA, 246 bp, Cercospora canescens
cttcggtgcgcttcccctttgggggactttgggagggatcattactgagtgagggccttcgggctcgacctccaaccctttgtgaacacaacttgttgcttcgggggcgaccctgccgtttcgacggcgagcgcccccggaggccttcaaacactgcatctttgcgtcggagtttaagtaaattaaacaaaactttcaacaacggatctcttggttctggcatcgatgaagaacgcagcgaaatgc

SEQ ID NO: 1391 - DNA, 280 bp, Cercospora capsici
gactagctacataggcttcgggctcgacctccaccctttgtgaacacaacttgttgcttcgggggcgaccctgccgtttcgacggcgagcgcccccggaggccttcaaacactgcatctttgcgtcggagtttaagtaaattaaacaaaactttcaacaacggatctcttggttctggcatcgatgaagaacgcagcagaaatgcgataagtaatgtgaattgcagaattcagtgaatcatcgaatctttgaacgcacattgcgccccttggtattccga

SEQ ID NO: 1392 - DNA, 220 bp, Cercospora kikuchii
cgtagggtgaacctgcggagggatcattactgagtgagggccttcgggctcgacctccaaccctttgtgaacacaacttgttgcttcgggggcgaccctgccgtttcgacggcgagcgcccccggaggccttcaaacactgcatctttgcgtcggagtttaagtaaattaaacaaaactttcaacaacggatctcttggttctggcatcgatgaagaacg

SEQ ID NO: 1393 - DNA, 243 bp, Cercospora zinnia
tcgattgaatggctcagtgaggccttcggactggcccagggaggtcggcaacgaccacccagggccggaaagttggtcaaactcggtcatttagaggaagtaaaagtcgtaacaaggtctccgtaggtgaacctgcggagggatcattactgagtgagggccttcgggctcgacctccaaccctttgtgaacacaacttgttgcttcgggggcgaccctgccgtttcgacggcgatcacttgt

SEQ ID NO: 1394 - DNA, 291 bp, Chaetomium globosum
aaactccctaaccattgtgaacgttacctataccgttgcttcggcgggcggccccggggtttaccccccgggcgcccctgggccccaccgcgggcgcccgccggaggtcaccaaactcttgataatttatggcctctctgagtcttctgtactgaataagtcaaaactttcaacaacggatctcttggttctggcatcgatgaagaacgcagccatcattagagagttgcaaactccctaaacccttgtgaacgtaacctataccgttgcgttcggcgggcggcccccggg

SEQ ID NO: 1395 - DNA, 263 bp, Chaetomium piluliferum
cattacagagttgcaaaactccctaaaccattgtgaacgttaccttcaaaccgttgcttcggcgggcggccccgctccgcccggtgccccctggccccctagcggggcgcccgccggaggaaaacccaactcttgattataatggcctctctgtctcttctgtactgaataagtcaaaactttcaacaacggatctcttggttctggcatcgatgaagaacgcagcgaaatgcgataagtaatgtgaattgcagaattcagtg

SEQ ID NO: 1396 - DNA, 210 bp, Chaetomium sp.
ctccctaaccattgtgaacgttacctaaaccgttgcttcggcgggcggccccggggtttaccccccgggcgcccctgggccccaccgcgggcgcccgccggaggtcaccaaactcttgataatttatggcctctctgagtcttctgtactgaataagtcaaaactttcaacaacggatctcttggttctggcatcgatgaaaaacgcagc

SEQ ID NO: 1397 - DNA, 255 bp, Cladosporium cladosporioides
tctaccaccgggatgttcataaccctttgttgtccgactctgttgcctccggggcgaccctgccttcgggcgggggctccgggtggacacttcaaactcttgcgtaactttgcagtctgagtaaatttaattaataaattaaaacttttaacaacggatctcttggttctggcatcgatgaagaacgcagccaaaccagcaaacccggtctaacccccgggatgttcatgaccctttgttgtccgactctgaggc

SEQ ID NO: 1398 - DNA, 240 bp, Cladosporium sp.
actgcttcattacaacaacgcccgggcttcggcctggttattcaaaaccctttgttgtccgactctgttgcctccgcggcgaccctgccttcgggcgggggctccgggtggacacttcaaactcttgcgtaactttgcagtctgagtaaacttaattaataaattaaaacttttaacaacggatctcttggttctggcatcgatgaagaacggagcgaaatgcgataagtaatgaattgc

SEQ ID NO: 1399 - DNA, 226 bp, Cladosporium uredinicola
ggtctaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaaatcaagtgggtctgcccccgcgatgggat

SEQ ID NO: 1400 - DNA, 250 bp, Cochliobolus sp
gctaattaaccaataacctatgaaggctgtacgccgctgcgcccccggccagttggctgaggctggattatttattaccccttgtcttttgcgcacttgttgtttcctgggcgggttcgcccgcctccaggaccacaccataaaccttttttatgcagttgcaatcagcgtcagtacaacaaatgtaaatcatttacaactttcaacaacggatctcttggttctggcatcgatgaagaaccgcaacagc

SEQ ID NO: 1401 - DNA, 249 bp, Phanerochaete crassa
ggttgtagctggcctcatactgggcatgtgcacacctggctcatccactccttaacctctgtgcactttttgtaggctctggttgaaaggcgttgcttcacttcggtgtggtaatcgctggaagacctggtctatgttttattacaaacgcttcagttatacaatgtttatctgcgtataacgcatttatatacaactttcagcaacggatctcttggctctcgcatcgatgaagaacgcagctcgagt

SEQ ID NO: 1402 - DNA, 267 bp, Phoma americana
cgtacgctacatggaagtaaaagtagtaacaaggtttccgtaggtgaacctgcggaaggatcattacctagagttgtaggctttgcctgctatctcttacccatgtcttttgagtaccttcgtttcctcggcgggtccgcccgccgattggacaatttaaaccatttgcagttgcaatcagcgtctgaaaaaacttaatagttacaactttcaacaacggatctcttggttctggcatcaatgaaaaacgcagcaacacaaaattac

SEQ ID NO: 1403 - DNA, 205 bp, Phoma subherbarum
tacgtgcagcgctttgcctgctatctcttacccatgtcttttgagtaccttcgtttcctcggcgggtccgcccgccgattggacaatttaaaccatttgcagttgcaatcagcgtctgaaaaaaacttaatagttacaactttcaacaacggatctcttggttctggcatcgatgaagaacgcagcttacctagagaatgcgtgt

SEQ ID NO: 1404 - DNA, 264 bp, Phomopsis liquidambari
aggcgcacccagaaaccctttgtgaacttataccttactgttgcctcggcgcatgctggccccctcggggtcccctggagacagggagcaggcacgccggcggccaagttaactcttgtttttacactgaaactctgagaaaaaaacacaaatgaatcaaaactttcaacaacggatctcttggttctggcatcgatgaagaacgcacaagtggagggccccaggcgcccccccaaaaccttttttgagttattacttactgtt

SEQ ID NO: 1405 - DNA, 222 bp, Phomopsis sp.
ccggcgcacccagaaaccctttgtgaacttatacctactgttgcctcggcgcaggccggccttttgtcaaaaaaggccccctggagacagggagcagcccgccggcggccaaccaaactcttgtttctacagtgaatctctgaggaaaaaacataaatgaatcaaaactttcaacaacggatctcttggttctggcatcgatgaagaacgcagcatgctggc

SEQ ID NO: 1406 - DNA, 255 bp, Pleospora sp.
cgggttgggacctcacctcggtgagggctccagcttgtctgaattattcacccatgtcttttgcgcacttcttgtttcctgggcgggttcgcccgccaccaggaccaaaccataaacctttttgtaattgcaatcagcgtcagtaaacaatgtaattattacaactttcaacaacggatctcttggttctggcatcgatgaagaacgcagcgaaatgcgatacgtagtgtgaattgcagaattcagtgattttgc

SEQ ID NO: 1407 - DNA, 349 bp, Pleosporaceae sp.
ggatcattacacaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattaccactttcaacaacgggatctcttggttctgggcatcgagcagaaaaacgcagaattgaaggcgggctgggaacctcttcgggggggtccagggctttggtgaattattcaccccttgcctttgcgtacgttgtttgttttccttggggggggtaggcacacaaaaaaagaaaacgg

SEQ ID NO: 1408 - DNA, 228 bp, Polyporales sp.
ctgaggcatgtgcacgccctactcatccactctcaacctctgtgcacttactgtaggtcggtgaaaggttcgctctgcgagctggaagccttcctatgtttcactacaaacgcttcagttttagaatgaaccttgcgtaaacgatctattacactttcacaacggactcttggccttggtgagaacgcagagcactttgtggggtcgtggtctcccgggggcctcccc

SEQ ID NO: 1409 - DNA, 222 bp, Preussia africana
aagtaccattatcgtagggcttcggccctgtcgagatagaacccttgcctttttgagtaccttttcgtttcctcggcaggctcgcctgccaatggggaccccaacaaacactttgcagtacctgtaaacagtctgaacaaacttttaaaaattaaaactttcaacaacggatctcttggttctggcatcgatgaagaacgcagcgaaatgcgataaaacgtg

SEQ ID NO: 1410 - DNA, 218 bp, Preussia sp.
ttcgagatacacccttgcctttttgagtaccttttcgtttcctcggcaggctcgcctgccaacggggacccttcaaaacgctttgtaatacctgtaactgtctgatataacaagcaaaaatcaaaactttcaacaacggatctcttggttctggcatcgatgaagaacgcagcaatcgttgggcttcggcccattagagataacacccttgccttttt

SEQ ID NO: 1411 - DNA, 254 bp, Pseudozyma sp.
acatctcgcggttcagccttgttgagtattcacccttgttttttgcggagaaatgtttgggtggagggagcaccagcaccaagacaaatctaaaccttttgcaattgcaatacgggcgacatttaccttaataattgttgatttcataagattatatcttggttgaaactccactggtaatgccatcgtctaaaatctaaaaacaacttttggcaacggatctcttggttctcgcatcgatgaagaacgcagcc

SEQ ID NO: 1412 - DNA, 277 bp, Pyrenophora teres
aggcagattgggtagtccccgcttttggggtttgcccattctggcgccatattcacccatgtcttttgcgtactacttgtttccttggcgggttcgcccgccaattggactttattcaacccttttttttttattgcaatcagcgtcagcaaaacaatgtaatcaatttacaactttcaacaacggatctcttggttctggcatcgatgaaaaacgcagccacaatatgatggccgatggggcaggcctcttttggggttgccccctctggcgccct

SEQ ID NO: 1413 - DNA, 289 bp, Colletotrichum capsici
gctcatcaccctttgtgacataccttaactgttgcttcggcgggtaggcgtcccctgaaaaggacgtctcccggccctctcccgtccgcgggtggggcgcccgccggaggataaccaaactctgatttaacgacgtttcttctgagtgacacaagcaaataatcaaaacttttaacaacggatctcttggttctggcatcgatgaagaacgcagcaattattggggtgttgctcatcatcctttgtggtgaaccttaactgttgctgcggcggggggcggcgtcccctg

SEQ ID NO: 1414 - DNA, 216 bp, Coniolariella gamsii
tgacactcccaaaacccctgtgaacataccgtacgttgcctcggcgggggggcgctccccccccgccggcggcccacgaaactctgttttgccctgaatctctgaaacgacaaactaaatcagttaaaactttcaacaacggatctcttggttctggcatcgatgaagaacgcagcgaaatatagaagtgacccaactcctaaccactgtgaacaa

SEQ ID NO: 1415 - DNA, 268 bp, Coniothyrium aleuritis
tagacttcactaaagcttgtagacttcggtctgctacctcttacccatgtcttttgagtaccttcgtttcctcggcgggtccgcccgccgattggacaacattcaaaccctttgcagttgcaatcagcgtctgaaaaaacataatagttacaactttcaacaacggatctcttggttctggcatcgatgaagaacgcagcgaaatgcgataagtagtgtgaattgcagaattcagtgaatcatcgaatctttgaacgcacattgcgcc

SEQ ID NO: 1416 - DNA, 210 bp, Coniothyrium sp.
gggctggatctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcaacactaatatg

SEQ ID NO: 1417 - DNA, 218 bp, Corynespora cassiicola
cgccccttcgagatagcaccctttgtttatgagcacctctcgtttcctcggcaggctcgcctgccaacggggacccaccacaaacccattgtagtacaagaagtacacgtctgaacaaaacaaaacaaactatttacaactttcaacaacggatctcttggttctggcatcgatgaagaacgcagcggatatcgtaggggccgcgcccccttccagat

SEQ ID NO: 1418 - DNA, 204 bp, Diaporthe sp.
accctttgtgaacttatacctaccgttgcctcggcgcaggccggcccccctcaccgggggccccccggagacggggagcagcccgccggcggccaaccaaactcttgtttcttagtgaatctctgagtaaaaatcataaatgaatcaaaactttcaacaacggatctcttggttctggcatcgatgaagaacgcagcaagttgc

SEQ ID NO: 1419 - DNA, 281 bp, Diatrype sp.
ccatgtgaacttacctttgttgcctcggcgggagagcctacccggtacctaccctgtagttacccgggagcgagctaccctgtagcccgctgctggccgacccgccggtggacagtaaaactcttgttttttagtgattatctgagtgtttatacttaataagttaaaactttcaacaacggatctcttggttctggcatcgatgaagaacgcagccaatacagagttatcttctcccagcccatgtgaacttacctttgttgccccggcgggagagccta

SEQ ID NO: 1420 - DNA, 338 bp, Drechslerella dactyloides
ggttagaaactgttgtttcggcgggatctctgccccgggggcgtcgcagccccggaccaagggggccgccggaggaccaaccaaaactctttttgtataccccctcgcgggttttttttataatctgagccttctcggcgcctctcgtaggcgtttcgaaaatgaatcaaaacttttaaaaacggatctcttggttctggcatcggatgaagaacgcagagaaatgcgataagtaatgtgaattgcagaattcactgaatcatctaatctttgaacggacattgcgcccgccagttttctggcgggcatgcctgtccgagcgtcatttcaaccctcga

SEQ ID NO: 1421 - DNA, 247 bp, Embellisia indefessa
tgctttttttgaacgcacattgcgccctttggtattccaaagggcatgcctgttcgagcgtcatttgtaccctcaagctttgcttggtgttgggcgtcttgtctccagttcgctggagactcgccttaaagtcattgcagccggcctactggtttcggagcgcagcacaagtcgcgctctcttccagccaaggtcagcatccacaaagccttttttcaacttttgacctcggatcaggtatcgatgc

SEQ ID NO: 1422 - DNA, 207 bp, Epicoccum nigrum
ttgtagacttcggtctgctacctcttacccatgtcttttgagtaccttcgtttcctcggcgggtccgcccgccgattggacaacattcaaaccctttgcagttgcaatcagcgtctgaaaaaacataatagttacaactttcaacaacggatctcttggttctggcatcgatgaaaaacgcatcacctagagtttgtagacttcggt

SEQ ID NO: 1423 - DNA, 234 bp, Epicoccum sp.
gtacttacctacgatttgtggagttcggtctgctacctcttacccatgtctttttaagtaccttcgtttcctcggcgggtccgcccgccggttggacaacattcaaaccctttgcagttgcaatcagcgtctgaaaaaacttaatagttacaactttcaacaacggatctcttggttctggcatcgaacacaaacgcagcagcttttagggacctaccgtctcctcctcttacc

SEQ ID NO: 1424 - DNA, 237 bp, Exserohilum rostratum
gctaatttccccaccaaacttgtagggtgtggtttgctggcaacagcgaaccgccccaagtatttttcacccatgtcttttgcgcactttttgtttcctgggccagttcgctcgccaccaggacccaaccataaacctttttttatgcagttgcaatcagcgtcagtataataattcaatttattaaaactttcaacaacggatctcttggttctggcatcgatgaagaacgcacaa

SEQ ID NO: 1425 - DNA, 223 bp, Fusarium chlamydosporum
tcccaacccctgtgacatacctatacgttgcctcggcggatcagcccgcgccccgtaaaacgggacggcccgcccgaggacccctaaactctgtttttagtggaacttctgagtaaaacaaacaaataaatcaaaactttcaacaacggatctcttggttctggcatcgatgaagaacgcagctcgatgaagaacgcagccccctccccacgggtgggaacat

SEQ ID NO: 1426 - DNA, 258 bp, Fusarium sp.
cactcccaacccatgtgaacttatctctttgttgcctcggcgcaagctacccgggacctcgcgccccgggcggcccgccggcggacaaaccaaactctgttatcttagttgattatctgagtgtcttatttaataagtcaaaactttcaacaacggatctcttggttctggcatcgatgaagaacgcagcaaatcattacagaattatccaactcccaaacccatgtgaacttttctttttgttgcctcggcgcaagc

SEQ ID NO: 1427 - DNA, 236 bp, Gibellulopsis nigrescens
atactcataaccctttgtgaccttcatacctgttgcttcggcggcgcgcctctcggggcgtgcccgccggcattatcagaatctctgttcgaacccgacgatacttctgagtgttctaagcgaactgttaaaactttcaacaacggatctcttggctccagcatcgatgaagaacgcagcaaatgaggggtactactctcacccccctttggcctcttcccacttgttgcttcggc

SEQ ID NO: 1428 - DNA, 243 bp, Gnomoniopsis sp.
cgggtgctacccagaaaccctttgtgaattattctcattgttgcctcggcattgactggcctcttctggaggtcccttttccttcggggaaaggagcaggtcggccggtggccctataaactctttgtttttacagtgtatcttctgagtaaacaactataaatgaatcaaaacttttaacaacggatctcttggttctggcatcgatgaagaacgcagcaatggaacaaacgccctccgggg

SEQ ID NO: 1429 - DNA, 251 bp, Lewia infectoria
gcgggctggacacccccagccgggcactgcttcacggcgtgcgcggctgggccggccctgctgaattattcacccgtgtcttttgcgtacttcttgtttcctgggtgggctcgcccgccatcaggaccaaccacaaaccttttgcaatagcaatcacggtcagtaacaacgtaattaattacaactttcaacaacggatctcttggttctggcatcgatgaagaacgtagcgaaatgcgatacgtagtgtg

SEQ ID NO: 1430 - DNA, 210 bp, Mycosphaerella coffeicola
aagtcgtactggcttcgggctcgacctccaccctttgtgaacacaacttgttgcttcgggggcgaccctgccgtttcgacggcgagcgcccccggaggccttcaaacactgcatctttgcgtcggagtttaagtaaattaaacaaaactttcaacaacggatctcttggttctggcatcgatgaagaacgcagcggtctgcacacatcag

SEQ ID NO: 1431 - DNA, 213 bp, Mycosphaerellaceae sp.
gaccacggccggccgcgccagcgataatcctttgtgccccgacattgttgcctgccttttgaccctgccttggggcgggggctccgggtggacacttaaactcttgcgtaactttgcagtctgagtaaacttaattaataaattaaaacttttaacaccggatctcttggttctggcatcgatgacaaaacgcaacaaacgcagcagttaacc

SEQ ID NO: 1432 - DNA, 227 bp, Nigrospora oryzae
ctcccaacccatgtgaacttatctctttgttgcctcggcgcaagctacccgggacctcgcgccccgggcggcccgccggcggacaaaccaaactctgttatcttcgttgattatctgagtgtcttatttaataagtcaaaactttcaacaacggatctcttggttctggcatcgatgaagaacgcagcaaaaaacgcagcattatcccactcccaaacccgtgggaa

SEQ ID NO: 1433 - DNA, 216 bp, Nigrospora sp.
cccatgtgaacatatctctttgttgcctcggcgcaagctacccgggacctcgcgccccgggcggcccgccggcggacaaaccaaactctgttatcttcgttgattatctgagtgtcttatttaataagtcaaaactttcaacaacggatctcttggttctggcatcgatgaagaacgcagcagaaacgctcagccaactcccagacccgtgtgaag

SEQ ID NO: 1434 - DNA, 249 bp, Nigrospora sphaerica
actcccaaacccatgtgaacatatctctttgttgcctcggcgcaagctacccgggacctcgcgccccgggcggcccgccggcggacaaaccaaactctgttatcttcgttgattatctgagtgtcttatttaataagtcaaaactttcaacaacggatctcttggttctggcatcgatgaagaacgcagcaaaaaaaaaaatattccactccccaagccgggggggaaaatttttttttttttttttgg

SEQ ID NO: 1435 - DNA, 223 bp, Paecilomyces sp.
aatgcggactcccaaaccactgtgaacatacccgtaccgttgcctcggcgggcggccccagggcggggccgcagcctccccagcggaggcgcccgccgcaggtcgcaaaactataactatatttagtggcatctctgagtaacttccaaacaatcaaaactttcaacaacggatctcttggttctggcatcgatgaagaacgcagccaatacagaacttcgcg

SEQ ID NO: 1436 - DNA, 205 bp, Penicillium citrinum
aagtacgtgaacggggcaaacctcccacccgtgttgcccgaacctatgttgcctcggcgggccccgcgcccgccgacggcccccctgaacgctgtctgaagttgcagtctgagacctataacgaaattagttaaaactttcaacaacggatctcttggttccggcatcgatgaagaacgcagcatctggcatcggctgcaattcg

SEQ ID NO: 1437 - DNA, 213 bp, Retroconis sp.
gctatcccaaccattgtgaacctacctacaaccgttgcttcggcgggcggccccgggtctccccgggcgcccctccggcccctcgcgggggcccgccggaggtacgcaaccctctgtatttgcatggcctctctgagtctctgtactgaataagtcaaaactttcaacaacggatctcttggttctggcatcgatgaagaacgcagcagctac

SEQ ID NO: 1438 - DNA, 253 bp, Rhizopycnis sp.
gaaatattgggggtaagtttacgcttaaccaaaccgttccgtaggtgaacctgcggaaggatcattatcgatttcggtttacaccgttttctacctttgtctatgcgtaccacacgttccctcggggggcttggcccccactaggaccaaacataaacctttggtaatggcaatcggggtctgaaataatttaattattacaactttaaacaacggatctctgggttctggcatcggtaaaaaaacacaggaa

SEQ ID NO: 1439 - DNA, 210 bp, Schizothecium inaequale
tgcaactcccaaccattgtgaacctacctcaccgttgcctcggcgggtggcccccacccgggccgcgccggccccaccgggccggcaacccgtcagaggaccgcaactcttagtcatcattggcctctctgagtaacttatacaataagtcaaaactttcaacaacggatctcttggttctggcatcgatgaagaacgcagcaagtctaa

SEQ ID NO: 1440 - DNA, 237 bp, Stagonospora sp.
ctagctactggcatggggactgttagtctgcatggtatcactaccgatgagcagcaggtcccctgtctatacccttgttttttgcgtacctattgtttcctcggcgggcttgctcgccggctggacaaaatctataacctttttttaatcttcaatcagcgtctgaaattatacataataattacaactttcaacaacggatctcttggttctggcatcgatgaaaaacgcagccaa

SEQ ID NO: 1441 - DNA, 223 bp, Stemphylium lancipes
aaatgtggcgccctttggtattccaaagggcatgcctgttcgagcgtcatttgtaccctcaagctttgcttggtgttgggcgtctttgtctctcacgagactcgccttaaaatgattggcagccgacctactggtttcggagcgcagcacaattcttgcactttgaatcagccttggttgagcatccatcaagaccacatttttttaactttttaccgtacta

SEQ ID NO: 1442 - DNA, 209 bp, Thielavia hyrcaniae
ctaaaccattgtgaacctaccttctaccgttgcttcggcgggcgggccccagcgccccccccggccccccgcgggcgcccgccggaggatacccaaactcttgacattagtggcctctctgagtattctttactgaataagtcaaaactttcaacaacggatctcttggttctggcatcgatgaagaacgcagcaatttacagagttgc

SEQ ID NO: 1443 - DNA, 252 bp, Thielavia sp.
aaccattgtgacgttaccttcaaaccgttgcttcggcgggcggcccgggtccgcccggtgccccctggccccctcgcggggcgcccgccggaggaaacccaactcttgatacattatggcctctctgagtcttctgtactgaataagtcaaaactttcaacaacggatctcttggttctggcatcgatgaagaacgcagcgaaatgcgataagtaatgtgaattgcagaattcagtgaatcatcgaatcttt

SEQ ID NO: 1444 - DNA, 217 bp, Ulocladium chartarum
tgaagcgggctggcatccttcggggttacagccttgctgaattattcacccgtgtcttttgcgtacttcttgtttccttggtgggttcgcccaccataggacaaaccataaaccttttgtaattgcaatcagcgtcagtaaaaaaattaataattacaacttttaacaacggatctcttggttctggcatcgatgaagaacgcagccacttacaaaa

SEQ ID NO: 1445 - DNA, 219 bp, Verticillium sp.
gtacacgatactcataaccctttgtgaaccttcatacctgttgcttcggcggcgcgcctctcggggcgtgcccgccggcattatcagaatctctgttcgaacccgacgatacttctgagtgttctaagcgaactgttaaaactttcaacaacggatctcttggctccagcatcgatgaagaacgcagcaaggatcaatgaatttctcaccacccaagta

SEQ ID NO: 1446 - DNA, 1377 bp, Burkholderia caledonica
tagcaatcctggtggcgagtggcgaacgggtgagtaatacatcggaacgtgtcctgtagtgggggatagcccggcgaaagccggattaataccgcatacgatctgtggatgaaagcgggggatccttcgggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatcccagcaatgccgcgtgtgtgaagaaggccttcgggttgtaaagcacttttgtccggaaagaaaacctcgtggttaatacccgtgggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaacctggctgagaggtccgggtgcccgaaagggagccataacacagggtgctgcatggctgtcgtcagctcgtgtcgtgagatgttgggataagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacg

SEQ ID NO: 1447 - DNA, 785 bp, Microbacterium binotii
tgcagtcgaacggtgaagcagagcttgctctgtggatcagtggcgaacgggtgagtaacacgtgagcaacctgccctggactctgggataagcgctggaaacggcgtctaatactggatacgagacgtggccgcatggtcaacgtttggaaagattttttggttcaggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcaaggaagaagcgaaagtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaaactggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagc

SEQ ID NO: 1448 - DNA, 1433 bp, Bacillus sp.
tatacatgcagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgcttgtaccttgacggtacctaacccagaaagccacggctaactacgtgccagcagccgcggtaatacgtaggtggcaagcgttatcccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccagggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaa

SEQ ID NO: 1449 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgacgtcgtccccacccctccctt

SEQ ID NO: 1450 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactaggcgattccagcttcacgcagtcgagttgcagactgcgatccggactacgatcggttttctgggattggctccacctcgcggcttgcaacccctctgttccgaccattgtatgacgtgtgaagccctacccataagggccatgaggacttgacgtcatccccaccttcctccg

SEQ ID NO: 1451 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagagactccgacttcatggggtcgagttgcagaccccaatccgaactgagaccggctttttgagattcgctccacctcacggcatcgcaactctttgtaccggccattgtagcacgtgtgcagcccaagacataaggggcatgatgacttgacgtcgtccccaccttcctccg

SEQ ID NO: 1452 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgcagtcgagttgcagactgcaatccggactacgaccggcttctgggattggctccagctcgcgctttggcaaccctctgtaccggccattgtatgacgtgtgaagccctacccataagggccatgaggacttgacgtcatccccaccttccccggtc

SEQ ID NO: 1453 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgtagagggcgttttttgggattggctccttatcgctaagtggcagccctttgtacgccccattgtagcacgtgtgtagccctgggcataaaggccatgatgacttgaccatcatcccctcttcctc

SEQ ID NO: 1454 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggctttttgggatttgctcactctcgcgagtttgctgccccgttgtcaccgccattgtagcacgtgtgtagcccagcgcgtaagggccatgaggacttgacgtcatccccacctcctccggg

SEQ ID NO: 1455 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccagcttcatgtaggcgagttgcagcctacaatccgaactgagaatggttttatggggattcgctccacctcgcggtcttgcaaccctttgtaccatccattgtagcacgtgtgtagcccaggtcataaggggcatgatgatttgacgtcatccccaccttcctccg

SEQ ID NO: 1456 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aaaacccgggaacgtattcaccgcggcatgctgatccgcgattactagcgattccaacttcacgcagtcgagttgcagactgcgatccggactacgatacactttctgggattagctccccctcgcgggttggcggccctctgtatgtaccattgtatgacgtgtgaagccctacccataagggccatgaggacttgacgtcatccccaccttcctccgg

SEQ ID NO: 1457 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaggcgtttttgggaattggcctccttatcgctaagtggcagccctttgtacgccccattgtagcacgtgtgtagcctgggcataaaggccatgatgacttgacatcatcccctccttctcacg

SEQ ID NO: 1458 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggcttttggagattagctcaccctcgcggggtcgctgctcactgtcaccgccattgtagcacgtgtgtagcccagcgcgtaagggccatgaggacttgacgtcatccccacttcctccggcc

SEQ ID NO: 1459 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggcccgggaacgtattcaccgcagcgttgctgatctgcgattactagcgactccgacttcacgcagtcgagttgcagactgcgatccgaactgagaccggctttaagggattcgctccacctcgcggtatcgcacgccctctgtaccagccattgtagcatgtgtgaacgccctggacataaggggcatgatgacttgactcactccccaccttcctc

SEQ ID NO: 1460 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggccggaacgtattcgaccgcggcaatgctgatccgcgattactagcgattccgacttcacggagtcgagttgcagactccgatccggacaggatggggtttctgggattggctccggctcgcgccttggcgaccctctgtccccaccattgtagtacgtgtgtagccctggccgtaagggccatgatgacttgacgtcatccccaccttcctccggt

SEQ ID NO: 1461 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgtagtcgagttgcagactacaatccggacacgattacactttctgggattagctccccctcgcgggttggcggccctctgtatgtaccattgtatgacgtgtgaagccctacccgataagggccatgaggacttgacgtcatccccaccttcctccg

SEQ ID NO: 1462 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggcccgggaacgtattcaccgcgacattctgattcgcgattactagcgattccgacttcacgcagtcgagttgcagactgcgatccggactacgatcggttttgtgggattagctccacctcgcggcttggcaaccctctgtaccgaccattgtagcacgtgtgtagcccagcgtaggccatgatgacttgacgtcatccccaccttcctccggtttg

SEQ ID NO: 1463 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Mycobacteriaceae
aaggcccgggaacgtattcgaccgcagcgttgctgatctgcgattactagcgactcctacttcacggggtcgagttgcatacccctatccgaactgagaccggctttgaaaggattcgctccacctcacggcatcgcagccctttgtaccggccattgtagcatgtgtgaagccctggacataaggggcatgatgacttgacgtcatcccaccttcctcc

SEQ ID NO: 1464 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
agggcccgggaacatattcaccgcagcatgctgatccgcgattactagcaactccgacttcatggggtcgagttgcagaccccaatccgaactgagacaggctttttgagattcgctccgcctcacggcttcgcagctcattgtacctgccattgtagcacgtgtgcagcccaagacataaggggcatgatgacttgacgtcgtccccaccttcctccga

SEQ ID NO: 1465 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggtttttctgagattagctccccctcgcgggttggcagccctctgtaccggccattgtatgacgtgtgtagccctaccccataagggccatgatgaccctgacgtcatcccccaccttccc

SEQ ID NO: 1466 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggctttttccggatttcgctccccctcacgggctcgcaacggtttgtaccggccattcgtagcatgcgtgaagccctggacataaggggcagtgatgacttgacgtcatccccaccttcc

SEQ ID NO: 1467 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggacgtattcaccgtatcattgcgtggatatacgattactagcgattccagcttcatggagtcgagttgcagactccaatctgaactgagagacgttttttgagattggcttcacatcgctgtgttgctgctctttgtacgtcccattgtagcacgtgtgtagccctgggcataaaggccatgatgacttgacatcatcccctccttcctcg

SEQ ID NO: 1468 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggcccgggaacgtattcaccgcagcgttgctgatctgcgattactagcgactccgacttcacggggtcgagttgcagaccccgatccgaactgagaccagcttttttgggattgctccaccttacggtctcgcagccctttgtactggccattgtagcatgcgtgaagcccaagacataaggggcatgatgatttgacgtcatccccaccttcctccg

SEQ ID NO: 1469 - DNA, 220 bp, Unknown
  Description of Unknown: 16S RNA Operational Taxonomic Unit polynucleotide
  Phylum: Cyanobacteria; Class: 4C0d-2; Order: SM1D11
aaggcccgggaacgtattcaacgcagcgtgctgatctgcgtttactagcgattccgacttcacgtagtcgagttgcagactacgatccgaactgaggggaggtttgtgggatttgccagacatcgctgccaagcgacccattgtcctcttcccattgtaacacgtgtgtagccctgggacataagggggcgtgatgattttgacgtcatccccaccttcc

SEQ ID NO: 1470 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggcccgggaacgaattcaccgcggcatgctgatccgcgattactagcaattccggcttcatgcaggcgagttgcagcctgcaatccgaacttacgaacggctttatgaagatttggctccacctcgcggtctcgcgtctctttgtaccgcccattgtagcacgtgtgtagcccaagacataaggggcatgatgatttgacgtcatccccgcttcctcc

SEQ ID NO: 1471 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccgggaacgtattcaccgcagcgttgctgatctgcgattactagcgactccgacttcatggggtcgagttgcagaccccaatccgaactgagaccggctttttgggattcgctcccctcacgggatcggcaggccctttgtaccggccattgtagcatgcgtgaagccctggacataaggggcatgatgacttgacgtcatcccaccttcctccg

SEQ ID NO: 1472 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagacccccgatccgaactgagaccggctttttgggattcgctccacctcacggcatcgcaaccctttgtaccggcccattgtagcatgcgtgaagcccctgggacatagggggcatgatgacttgacgtcatccccaccttcc

SEQ ID NO: 1473 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
aaggcccgggaacgtattcaccggatcatggctgatatccgattactagcgattccagcttcacggagtcgagttgcagactccgatccgaactgtgaccggtttattagattcgctcctggtcgcccagtggctgctctctgtaccggccattgtagcacgtgtgtagcccaaggcgtaagggccgtggatgtttgacgtcatccccaccttcctcaca

SEQ ID NO: 1474 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggctttttgggattcgctcaacctcacggtctcgcagccctttgtaccggccattgtagcatgcgtgaagccctggacataaggggcatgatgacttgacgtcatccccttcctccgagt

SEQ ID NO: 1475 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggccctggaacgtattcaccgcagcgttgctgatctgcgattactagcgactccgacttcacggggtcgagttgcagaccccgatccgaactgagaccagctttttgggattcgctccacctcacggtctcgcagccctttgtactggccattgtagcatgcgtgaagcccaagacataaggggcatgatgatttgacgtcgtccccaccttcctccg

SEQ ID NO: 1476 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgtttttgagattggctccttatcgctaagtggcagctctttgtccctcccattgtagcacgtgtgtagccctgggcataaaggccatgatgacttgacatcatcccctccttcctcgcg

SEQ ID NO: 1477 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
gaaggtccgggacgtattcaccgtatcattgctgatatacggattactagcgattccagcttcacgcagtcgagttgcagactgcgatctgaactgagaagaggttttgggattagctccttgtcgccaagtggcagccctttgtcctctccattgtagcacgtgtgtagccctgggcataaaggccatgatgacttgacatcatcccctcttcctcgcg

SEQ ID NO: 1478 - DNA, 220 bp, Unknown
  Description of Unknown: 16S RNA Operational Taxonomic Unit polynucleotide
  Phylum: Acidobacteria; Class: Acidobacteria-5
aaggcccgggaacgtattcaccgctgcttgctgatcagcgattactagcgattccagcttcatgcagtcgagttgcagactgcaatccgaactgagagcggttttttgagattggctccccctcgcgggtttgcgactcatgtgccgcccattgtagtacgtgtgtagccctggacataaaggccatgaggacttgacgtcatccccacccttcctccgg

SEQ ID NO: 1479 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaaagagtttttgagattagcgccttgtcaccaagtggcagctctttgtctcttccattgtagcacgtgtgtagccctggggcataaaaggccatgatgacttgacatcatcccccccttcctc

SEQ ID NO: 1480 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcgaccgcagcaatgctgatctgcgattactagcaactccgacttcatggggtcgagttgcagacccccaatccgaactgagactaaggcttttttgagattcgctccacctcacggtatcgcagctcattgtacctgccattgtagcacgtgtgcagcccaagacataaggggcatgatgacttgacgtcgtccccaccttc

SEQ ID NO: 1481 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgccctgatctgcggattactagcaactccgacttcatggggtcgagttgcagaaccccaatccgaactgagacaggcttttttgagattcgctcaacctcacggtatcgcagctctttgtacctgccattgtagcacgtgtgcagcccaagacataaggggcatgatgacttgacgtcgtcccaccttcc

SEQ ID NO: 1482 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Thermomonosporaceae
aaggcccgggaacgtattcaccgcagcgttgctgatctgcgattactagcgactccgacttcatggggtcgagttgcagacccatcgaactgagaccggctttaaggtagttcgctccaccttgcggtatcgcagccctctgtaccggccattgtagcatgtttgcagcccaagacataaggggcatgatgacttgacgtcatccccaccttcctccgag

SEQ ID NO: 1483 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacggattcaccgcagtatgctgacctgcgattactagcgattccgccttcatgcaggcgagttgcagcctgcaatctgaactgaggcagggttacgggattagctcgccctcgcggttgctgccctctgtccctacattgtagtacgtgtgtagcccaggacgtaaggggcatgctgacttgacgtcatccccaccttcctccggtttg

SEQ ID NO: 1484 - DNA, 220 bp, Unknown
  Description of Unknown: 16S RNA Operational Taxonomic Unit polynucleotide
  Phylum: Cyanobacteria; Class: Oscillatoriophycideae
aagggcccgggaacgaattcgaccgccgtatgctgaccggcgattactagcgattcctccttcatgcaggcgagttgcagcctgcaatctgaactgtgccccagtttatggattggcttgccatcgctggcttgctgccctttgtctggagcattgtagtacgtgtgtagcccaggacgtaaggggcatgctgacttgacgtcatcccaccttcctccgg

SEQ ID NO: 1485 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcatgcaggcgagttgcagcctacaatccgaactgagaccggcttttctcccgattagctccctctcgcgagatcgcgacggtttgtaccggccattgtagcacgtgtgtggccccagacataaaggccatgctgacttgacgtcatccccaccttcctcc

SEQ ID NO: 1486 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaaagggtttttgagattagcgccttgttgccaggtgcagctctttgtcccttcattgtagcacgtgtgtagccctgggcataaaggccatgatgacttgacatcatcccctccttcctccgtc

SEQ ID NO: 1487 - DNA, 220 bp, Unknown
  Description of Unknown: 16S RNA Operational Taxonomic Unit polynucleotide
  Phylum: Actinobacteria; Class: Actinobacteria; Order: Solirubrobacterales
aaggcccggacgtattcaccgcggcattgctgatccgcgattactagcaactccaccttcatggaggcgagtttcagcctccaatccgaaccgaggcgcactttatgggattgctccacctcgcggtattgctgccctttgtatgcgccaatgtagcacgtgtgtagccctggacataaggggcatgatgacttgacgtcatccccaccttcctccggtt

SEQ ID NO: 1488 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccgggaacgtattcaccgcagcgttgctgatctgcgattactagcgactccgacttcatggggtcgagttgcagacccccaatccaactgagaccggctttttgggattcgctccaccttgcggtttcgcagccctttgtaccggccattgtagcatgcttgaagccctggacataaggggcatgaagacttgacgtcatccccaccttcctccg

SEQ ID NO: 1489 - DNA, 220 bp, Unknown
  Description of Unknown: 16S RNA Operational Taxonomic Unit polynucleotide
  Phylum: Acidobacteria; Class: Acidobacteria; Order: Acidobacteriales
gaaggcccgggaacgtattcaccgcggcgtgctgatccgcgattactagcgattccaacttcatgcaggcgagttgcagcctacaatccgaactgagaccggctttctccgattagctccccttgcgggctcgcgacggtttgtaccggccattgtagcacgtgtgtggccccagacataaaggccatgctgacttgacgtcatccccacttcctccggt

SEQ ID NO: 1490 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgtagtcgagttgcagactacaatccgggacacgatacactttctgggattagctcccctcgcgggttggcggccctctgtatgtaccattgtatgacgtgtgaagccctacccataagggccatgaggacttgacgtcatcccaccttcctccggtt

SEQ ID NO: 1491 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Rhizobiaceae
aaggcccgggaacgtattcaccgcggcatgctgagtccgcgattactagcgattccaacttcatgcactcgagttgcagagtgcaatccgaactgagatggcttttggagattagctcgacctcgcggtctcgctgcccactgtcaccaccattgtagcacgtgtgtagcccagcccgtaagggccatgaggaccttgactcatccccaccttcctctcg

SEQ ID NO: 1492 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaaagctgatccgcgattactagcgattccgacttcacgcagtcgagttgcagactgcgatccggactacgaccgggtttctgggattagctccccctcgcgggttggcagccctcctgtcccggcccattgtatgacgtgtgtagccctacccataagggccatgatgacctgacgtcatccccacccttcct

SEQ ID NO: 1493 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccgggaacgtattcaccgcagcgttgctgatctgcgattactagcgactccgacttcatggggtcgagttgcagaccccaatccgaactgagaccggctttttgggattcgctccctcgcggcatcgcagccctttgtaccggccattgtagcatgcgtgaagccctggacataaggggcatgatgacttgacgtcatccccaccttcctccggt

SEQ ID NO: 1494 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggcccgggaacgtattcaccgcagcattgctgatctgcgattactagcgactccaacttcacggggtcgagttgcagaccccgatccgaactgagacccactttaagggtatcgctccacctcacggtctcgcagccctcctgtataggccattgtagcatgtgtgaagccctggacataaggggcatgatgacttgacgtcatccccaccttcctcg

SEQ ID NO: 1495 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcgttgctgatctgcgattactagcgactccgacttcatggggtcgagttgcagaccccaatccgaactgagacaggcttttttgagattcgctccaccttgcggtatcgcagctctttgtacctgccattgtagcacgtgtgcagcccaagacataaggggcatgatgacttgacgtcgtccccaccttcctcc

SEQ ID NO: 1496 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgaccgtcgtcccacttcctccgc

SEQ ID NO: 1497 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacaagctttttgcgattggctcctctcgcgagtttgcagcgctttgtacttgccattgtagcacgtgtgtagccctggacataaaggccatgaggacttgacgtcatcccccttcctccgtttg

SEQ ID NO: 1498 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aaggcccgggaacgaattcaccgcgacatgctgatccgcgattactagcgattccaacttcatgcagtcgagttgcagactacaatccggactacgatacactttctgcgattagctccccctcgcgggttgcggcgctctgtatgtaccattgtatgacgtgtgaagccctacccataagggccatgaggacttgacgtcatccccaccttcctccggt

SEQ ID NO: 1499 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcagcgtgctgatctgccattactagcgattccagcttcatgcaggcgagttgcagcctgcaatccgaactgagagcggttttttgcgattggctcccctcgcgggttcgcggcgcattgtaccgcccattgtagcacgtgtgtagccctggacataaaggccatgaggacttgacgtcatccccaccttcctccagc

SEQ ID NO: 1500 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
gaaggcccgggaacgtattcaccgcagcaatgctgatctgcgattactagcaactccgacttcatggggtcgagttgcagaccccaatccgaactgagaccggctttttgagattcgctccacctcacggtttcgcagctctttgtaccggccattgtagcacgtgtgcagcccaagcataaggggcatgatgacttgacgtcgtccccacttcctccga

SEQ ID NO: 1501 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacggcgccgtgctgatgcgccattactagcgattccggcttcatggaggcgagttgcagcctccaatccgaactgggcccagttttactagattcctccacctcgcggtcttggatcgttctgtactgggcattgtagtacgtgtgcagccctggccgtaagggccatactgacttgacgtcgtcccaccttcctcccgtt

SEQ ID NO: 1502 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgatgctgatccacgattactagcaattccagcttcatgccgtcgagttgcagacgacaatccgaactgagggcgggttttgggattgcctcggcattgctgcctcggccccctctgtcccgcccattgtagcacgtgtgtagccctagacgtaaggaccatgatgacttgacgtcgtccccaccttcctccgt

SEQ ID NO: 1503 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Actinosynnemataceae
aaggccggacgtatcgaccgcagcgttgctgatctgcgattactagcgactccgacttcacggggtcgagttgcagaccccgatccgaactgagaccggctttatgggattcgctccacctcacggcttagcagccctttgtaccggccattgtagcatgtgtgaagccctggacataaggggcatgatgacttgacgtcatccccaccttcctccgagt

SEQ ID NO: 1504 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggcccggggaacgtattcaccgcgtcattgctgatacgcgattactagcgattccagcttcacgaagtcgagttgcagacttcgatccgaactgagagcggctttttgagattggcatcctgtcaccaggtagcaaccctctgtaccgcccattgtagcacgtgtgtagccctaggcgtaagggccatgatgacctgacgtcatcccccaccttcctc

SEQ ID NO: 1505 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatggagtcgagttgcagactccaatccggactacgatacactttctgggattagctccccctcgcgggttggcagccctcctgtatgtaccattgtatgacgtgtgaagccctacccactaagggccgatgaggacttgacgtcatccccaccctcctc

SEQ ID NO: 1506 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacgagctttttgcgattggctcccccttgcaggtttgcagcgctttgtactcgccattgtagcacgtgtgtagccctggacataaaggccatgaggacttgacatcatcccctccttcctcacg

SEQ ID NO: 1507 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccagcttcatgtaggcgagttgcagcctacaatccgaactgagaacggtttttatgagatttagctcacctcgcggtcttgcagctctttgtaccgtccattgtagcacgtgtgtagcccaggtcataaggggcatgatgatttgacgtcatccccacttcctccgg

SEQ ID NO: 1508 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggcccgggacgtattcaccgcagcatgctgatctgcgattactagcgattccaacttcatgcactcgagttgcagagtgcaatccgaactgagatggcttttggagattagctcgacctcgcggtctcgctgcccactgtcaccaccattgtagcacgtgtgtagccccagcccgtaagggccatgaggacttgacgtcatccccaccttctctcggc

SEQ ID NO: 1509 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggcccgggaacgaattcaccgcggcatgctgatccgcgattactagcaattccggcttcatgcaggcgagttgcagcctgcaatccgaactacgaacggctttatgagattagctccgcctcacggcctcgcgtctctttgtaccgcccattgtagcacgtgtgtagcccaagacataaggggcatgatgatttgacgtcatcccgctcctccggttg

SEQ ID NO: 1510 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaaggggtttttgggattagcgccttgtcgccaagtggcagccctttgtcccctccatgtagcacgtgtgtagccctcgggcgataaaggccatgatgacttgacatcatccctccttcctccg

SEQ ID NO: 1511 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagacccaatccgaactgaggacaggcttttgagattcgctccgcctcacggcttcgcagctcattgtacctgccattgtagcacgtgtgcagcccaagacataaggggcatgattgacttgacgtcgtccccaccttcctccg

SEQ ID NO: 1512 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcgactccgacttcatggggtcgagttgcagaccccaatccgaactgagaccggctttttgagattcgctccacctcacggtatcgcagctctttgtaccggccattgtagcacgtgtgcacccaagacataaggggcgatgatgacttgacgtcgtccccacccttcctcc

SEQ ID NO: 1513 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggccggacgtattcgaccgcgacattctgattcgcgattactagcgattccgacttcacgcagtcgagttgcagactgcgatccggactacgatcggttttatgggattagctccacctcgcggcttggcaaccctctgtaccgaccattgtagcacgtgtgtagcccaggccgtaagggccatgatgacttgacgtcatccccacttcctccggttg

SEQ ID NO: 1514 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccaacttcacggggtcgagttgcagaccccgatccgaactgagaccggctttaagggattcgctccacctcacggtatcgcagccctctgtaccggccattgtagcatgtgtgaagccctggacagtaaggggcatgatgacttgaccgtccgtccccaccttcct

SEQ ID NO: 1515 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggccccggaacgtattcaccgcagcgttgctgatctgcgattactagcgactccgacttcacgcagtcgagttgcagactgcgatccgaactgagaccggctttaagggattcgctccacctcgcggtatcgcagccctctgtaccagccattgtagcatgtgtgaagccctggacataaggggcatgatgacttgacgtcatccccaccttcctccg

SEQ ID NO: 1516 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcacggggtcgagttgcagaccccgatccgaactgagaccggctttttgggtattcgctccacctcacggtatcgcagcccattgtaccggccattgtagcatgcgtgaagccctagacataaggggcatgatgacttgagtcatccccaccttcctcca

SEQ ID NO: 1517 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaaggtccgggaacgtattcaccgtatcattgctgatatacgattactagcgattccagcttcacgcagtcgagttgcagactgcgatctgaactgagaaagggtttttgagattagcgccttgtcgccaagtggcagctctttgtcccttccattgtagcacgtgtgtagccctgggcataaaggccatgatgacttgacatcatcccctcttcctcgc

SEQ ID NO: 1518 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactacgatccggactacgaccgggtttctgggattagctccccctccgcggggttgggcagccctctgtcccggccattgtatgacgtgtgtagccctacccataagggccatgatgacctgacgtcatccccaccttcctc

SEQ ID NO: 1519 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatccgaactgagaaagggtttttgagattcgcgccttgtcgccaagtggctgctctttgtccctcccattgtagtacgtgtgtagccctgggcataaaggccatgatgacttgacatcatccctccttcctcgcg

SEQ ID NO: 1520 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aagacccgggaacgtattcaccgcagcgttgctgatctgcgattactagcgactccgacttcatgaggtcgagttgcagacctcaatccgaactgggaccggctttttgggattcgctccacctcacggtattgccagccccctttgtaccggccattgtagcatgcgtgaagcccaagacataaggggcatgatgatttgacgtcatccccaccttcct

SEQ ID NO: 1521 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccggaactattcgaccgcagcaatgctgatctgcgattactagcgactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgacgtcgtccccaccttcctccga

SEQ ID NO: 1522 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Thermomonosporaceae
aaagcccgggaacgtattcaccgcagcgttgctgatctgcgattactagcgactccgacttcatggggtcgagttgcagaccccaatccgaactgagaccggctttaagggattcgctccaccttgcggtatcgcagccctctgtaccggccattgtagcatgtttgcagcccaagacataaggggcatgatgacttgacgtcatccccaccttcctccg

SEQ ID NO: 1523 - DNA, 220 bp, Unknown
  Description of Unknown: 16S RNA Operational Taxonomic Unit polynucleotide
  Phylum: Actinobacteria; Class: Actinobacteria; Order: Solirubrobacterales
aaggcccgggaacgtattcaccgcggcaatgctgatccgcgattactagcaactccaccttcatgcaggcgggtttcagcctgcaatccgaaccgagacgcgctttgagggattcgctccacctcgcggtatcgcagccctctgtacgcgccaatgtagcacgtgtgtagccctggacataaggcatgatgacttgactcatcccaccttcctccggttt

SEQ ID NO: 1524 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattccaccgcagcatagctgatctgcgattactagcgattccgacttcacgaagtcgagttgcagacttcgatccggactggggatcggctttctgggattggctccacctcgcggtattgcaaccctctgtaccgaccattgtagtacgtgtgtagccctgggccgtaagggccatgatgacttgacgcatccccaccttcctc

SEQ ID NO: 1525 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtacgggaacgtattcaccgtatcattgctgatatacgattactagcgattccagcttcatggagtcgagttgcagactccaatctgaactgagaaagagtttttgagattagcgccttgtcaccaagtggcagctctttgtctcttccattgtagcacgtgtgtagccctgggcataaaggccatgatgacttgacatcatcccctccttcctcgc

SEQ ID NO: 1526 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcaatgctgatctgcgattactagcgactccgacttcacggggtcgagttgcagaccccgatccgaactgagaccggctttttgggaattcgctccaccttgcggtatcgcagccctttgtaccggccattgtagcatgcgtgaagccctggacataaggggcatgatgacttgacgtcatccccaccttcctcc

SEQ ID NO: 1527 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccggaacgtattcgaccgcagcaatgctgatctgcgattactagcaactccgacttcatggggtcgagttgcagaccccaatccgaactgagacaggctttttgagattcgctccgcctcacggcttcgcagctcattgtacctgccattgtagcacgtgtgcagcccaagacataaggggcatgatgacttgacgtcgtccccacttcctccga

SEQ ID NO: 1528 - DNA, 220 bp, Unknown
  Description of Unknown: 16S RNA Operational Taxonomic Unit polynucleotide
  Phylum: Chloroflexi
acaaggcccgggaacatattcaccgcaccgtgctgatgcgcggttactagcaactccgacttcatgcaggcgagttgcagcctacaatccgaactgagaccggctttttgggatccgctccacctcgcggtctcgcttccctctgtaccggccattgtagcgtgtgtgtagcccaggacgtaagagccatgctgacttgacgtcatccccaccttcctcc

SEQ ID NO: 1529 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagaaggtttttgagattagctccctgtcaccaggtggcagccctttgtccttccactgtagcacgtgtgtagccctcgggcgataaaggaccatgatgacttgacatcatcccctccttcctc

SEQ ID NO: 1530 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagacaggctttttgagattcgctcaacctcacggtatcgcagctctttgtacctgccattgtagcacgtgtgcagcccaagacataaggggctgatgacttgacgtcgtcccccttcctccgagt

SEQ ID NO: 1531 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccgggaacgtattcaccgcagcgttgctgatctgcgattactagcgactccgacttcatggggtcgagttgcagacccccaatccgaactgagaccggcttttttgggattcccccccccttacgggatcgcagccctttgtaccggccattgtagcatgcgtgaagccctggacataaggggcatgatgacttgacgtcatccccaccttcctc

SEQ ID NO: 1532 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgaacaggctttttgtagattcgctccacctcacggtatcgcagctcattgtacctgccattgtagcacgtgtgcagcccaagacataaggggcatgatgacttgacgtcgtccccaccttcctccg

SEQ ID NO: 1533 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttgggattggctcccctcgcgggttggcagccctctgtaccggccattgtatgacgtgtgtagccctacccataagggccatgaggacctgacgtcatccccaccttcctccggttt

SEQ ID NO: 1534 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgtagtcgagttgcagactacaatccggactacgatacacttttctgggatagctccccctcgcgggttggcggccctctgtatgtaccattgtatgacgtgtgaagccctacccataagggccatgaggacttgacgtcatccccaccttcctccgg

SEQ ID NO: 1535 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Methylobacteriaceae
aaggccctggaacgtattcaccgtggcatgctgatccacgattactagcgattccgccttcatgcactcgagttgcagagtgcaatccgaactgagacggcttttggggatttgctccagatcgctccttcgcgtcccactgtcaccgccattgtagcacgtgtgtagcccatcccgtaagggccatgaggacttgacgtcatccacaccttcctcgcgg

SEQ ID NO: 1536 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccggaacgtattcgaccgcgagcaatgctgatctgcgattactagcaactccgacttcatggggtcgagttgcagacccccaatccgaactgagacaggctttttgagattcgctccacctcacggtatcgcagctcattgtacctgccattgtagcacgtgtgcagcccaagacataaggggcatgatgacttgacgtcgtccccaccttcctt

SEQ ID NO: 1537 - DNA, 220 bp, Unknown
  Description of Unknown: 16S RNA Operational Taxonomic Unit polynucleotide
  Phylum: Chloroflexi; Class: Chloroflexi; Order: Roseiflexales; Family: Kouleothrixaceae
aaggcccgggtacgtattcaccgcgccatggctgatacgcggttactagcaactccgccttcatgggggcgagttgcagccccaatctgcactgggccggtccttgggcgattcgcatctccttgcggagtagctgcgcgttgcgaccggcattgtagcgtgtgtgtcggccccagggcgtaagagccatgcggacttgacgtcatccccgccttcctcc

SEQ ID NO: 1538 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcacgggggtcgagttgcagaccccgatccgaactgagaccggctttttgggattcgctccacctcacggtattgcagccctttgtaccggccattgtagcatgcgtgaagcccaagacataaggggcatgatgatttgacgtcatccccaccttcctcc

SEQ ID NO: 1539 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcagcaatgctgatctgcgattactagcgattccgacttcacggagtcgagttgcagactccgatccggactacgatagattttctgggattggctccctctcgcgagttggcttccctctgtatctaccattgtagcacgtgtgtagccctggccataaaggccatgatgacttgacgtcatccccaccttcctccg

SEQ ID NO: 1540 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
gaggtccgggaacgtattcaccgcgccattgctgatgcgcgattactagcgattccaacttcatgcaggcgagttgcagcctgcaatccgaactgagacgtactttttgtgattggctcactgtcaccagcttgcaacactctgtatacgccattgtagcacgtgtgtagccctgggcgtaagggccatgatgacttgacgtcgtcccctccttcctctc

SEQ ID NO: 1541 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccggaacgtattcaccgcggcatgctgatccgcgattactagcaattccgacttcatgcaggcgagttgcagcctgcaatccgaactgagatcggcttataaggatggctccgcttcgcagcttcgcttcccgttgtaccgaccattgtagtacgtgtgtagcccaggtcataaggggcatgatgatttgacgtcatccccacctcctccggctt

SEQ ID NO: 1542 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcggcatgctgatccgcgattactagcgattccaacttcacgcagtcgagttgcagactgcgatccggacacgattacactttctgggattagctcccctcgcgggttggcggccctctgtatgtaccattgtatgacgtgtgaagccctaccataagggccatgaggacttgacgtcatccccaccttcctccggtt

SEQ ID NO: 1543 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccggaacgtattaccgcgagcaatgctgatctgcgattactagcgactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgacgtcgtccccaccttcctccga

SEQ ID NO: 1544 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggcccgggaacgtattcaccgcagcgttgctgatctgcgattactagcgactccaacttcacggggtcgagttgcagaccccgatccgaactgagactcactttaagggattcgctccacctcacggtctcgcagccctctgtatgagccattgtagcatgtgtgaagccctgggacagtaaggggcatgatgacttgacgtcatccccaccttcctc

SEQ ID NO: 1545 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggacgtattcaccgcagcgttgctgatctgcgattactagcgactccgacttcacggggtcgagttgcagaccccgatccgactgagaccggctttttgggattcgctccacctcacggcatcgcaaccctttgtaccggccattgtagcatgcgtgagccctggacataggggcatgatgacttgacgtcatccccaccttcctccgagtt

SEQ ID NO: 1546 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggacccgggaacggaattcaccgcggcatgctgatccgcgattactagcaattccggcttcatgcaggcgagttgcagcctgcaatccgaactacgaacggctttatgagattagctccacctcgcggtctcgcgtctctttgtaccgcccattgtagcacgtgtgtagcccaagacataaggggcatgatgatttgacgtcatccccgccttcctcc

SEQ ID NO: 1547 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagaaggtttttgggattagctccttgtcgccaagtggcagccctttgtccttcccattgtagcacgtgtgtagccctggggcataaggccatgatgacttgacatcatccctccttcctcgcg

SEQ ID NO: 1548 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgcagtcgagttgcagactgcaatccggacttacgatacactttctgggattagctccccctcgcgggttggcggcccccctgtatgtaccattgtatgacgtgtgaaggccctacccataagggccatgaggacttgacgtcatccccaccttccct

SEQ ID NO: 1549 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggacgtattcaccgtatcattgctgatatacgattactagcgattccagcttcacgcagtcgagttgcagactgcgatctgaactgagaaagggtttttgggtagttagctccttgtcgccaagtggcagccctttgtcccttccattgtagcacgtgtgtagccctgggcataaaggccatgatgacttgacatcatcccctccttccttc

SEQ ID NO: 1550 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccggaacgtattcgaccgcggcatgctgatccgcgattactagcgattccagcttcatgtaggcgagttgcagcctacaatccgaactgagaatggttttatgggattggcttgacctcgcggtcttgcagccctttgtaccatccattgtagcacgtgtgtagcccaggtcataaggggcatgatgatttgacgtcatcccaccttcctccggt

SEQ ID NO: 1551 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagaaggtttttgggattagctccttgtcgcaagtggcagccctttgtccttcccattgtagcacgtgtgtagccctgggcataaaggccatgatgacttgacatcatccctctcctcgcgtct

SEQ ID NO: 1552 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aagacccgggaacgtattcaccgcagcgttgctgatctgcgattactagcgactccgacttcatgaggtcgagttgcagacctcaatccgaactgggaccggcttttttgggtagttcgctccacctcgcggtattgcagccctttgtaccggccattgtagcatgcgtgaagcccaagacataaggggcatgatgatttgacgtcatcccacttcctcc

SEQ ID NO: 1553 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggcccggaacgtatcaccgcgacattctgattcgcgattactagcgattccgacttcacgcagtcgagttgcagactgcgatccggactacgatcggtttatgggattagctccacctcgcggcttggcaaccctttgtaccgaccattgtagcacgtgtgtagcccaggccgtaagggccatgatgacttgacgtcatccccaccttcctccggttt

SEQ ID NO: 1554 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgagaccggctttaaggatttgctccacctcgcggttttgctccccgttgtaccggccattgtagtacgtgtgtagcccaggtcataaggggcatgatgatttgacgtcatcccccaccttcctccgg

SEQ ID NO: 1555 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagacaggctttttgagattcgctccacctcacggtatcgcagctcattgtacctgccattgtagcacgtgtgcagcccaaaggcataagggcgatggatgacttgacgtcgtcccacttcctccg

SEQ ID NO: 1556 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagaccggtcttttttgagattcgctccacctcacggtatcgcagctcattgtaccggccattgtagcacgtgtgcagcccaagacataaggggcatgatgacttgacgtcgtccccaccttccct

SEQ ID NO: 1557 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggtttttggattcgctccctcgcggtttcgcagccctttgtaccggccattgtagcatgcgtgaagcccaagacataaggggcatgatgatttgacgtcatccccacttcctccgagttc

SEQ ID NO: 1558 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagacccccaatccgaactgagaccggcttttgtagattcgctccacctcacggcatcgcagctcattgtaccggccattgtagcacgtgtgcagcccaacgacataaggggcgatgatgacttgacgtcgtcccaccttcctc

SEQ ID NO: 1559 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggcccgggaacgtattcaccgcagcgttgctgatctgcgattactagcgactccgacttcacggggtcgagttgcagaccccgatccgaactgagaccagctttttgggattcgctccaccttacggtctcgcagccctttgtactggccattgtagcatgcgtgaacgcccaagacataaggggcatgatgatttgaccgtcgtcccaccttcctcc

SEQ ID NO: 1560 - DNA, 220 bp, Unknown
  Description of Unknown: 16S RNA Operational Taxonomic Unit polynucleotide
  Phylum: Actinobacteria; Class: Actinobacteria; Order: Actinomycetales
aagggcccgggaacgtattcgaccgcagcgttgctgatctgcgattactagcgactccgacttcacggggtcgagttgcagaccccgatccgaactgagaccagctttaagggattcgctccacctcacggtctcgcagccctctgtactggccattgtagcatgtgtgaagccctggacataaggggcatgatgacttgacgtcatcccaccttcctcc

SEQ ID NO: 1561 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
acaaggcccgggaacgtattcaccggatcatggctgatatccgattactagcgattccagcttcacggagtcgagttgcagactccgatccgaactgtgaccggttttatagattcgctcctggtcgcccagtggctgctctctgtaccggccattgtagcacgtgtgtagcccaaggcgtaagggccgtgatgatttgacgtcatcccaccttcctcac

SEQ ID NO: 1562 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacggattcaccgcagtatgctgacctgcgattactagcgattccgccttcatgcaggcgagttgcagcctgcaatctggaactgaggcagggtttacggattagctcgccctcgcgggttggctgccctctgtccctaccattgtagtacgtgtgtaggcccaggactaaggggcatgctgacttgacgtcatccccaccttcctccgg

SEQ ID NO: 1563 - DNA, 220 bp, Unknown
  Description of Unknown: 16S RNA Operational Taxonomic Unit polynucleotide
aaagtactagtaacatattcaccgcagcatgctgttctgcgattactagcgattccagcttcatatgggcgagtttcagcccataatccgaactaagataatcttaaagatttgctccaatttttaatcactattgcttctcattgtaattatcattgtagcacgtgtgtagcccaactcataagggccatgaagacttgacgtcatccctaccttcctt

SEQ ID NO: 1564 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Actinosynnemataceae
aaggcccgggaacgtattcaccgcagcgttgctgatctgcgattactagcgactccgacttcacggggtcgagttgcagacccccgatccgaactgagaccggctttatgggattcgctccacctcacggtttagcagccctttgtacccggccattgtagcatgtgtgaagcccctggacataagggggcatgatgacttgacgtcatccccaccttcc

SEQ ID NO: 1565 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccagcttcacgtagtcgagttgcagactacgatccggactacgatgcatttctgggattagctccacctcgcggcttggcaaccctctgtatgcaccattgtatgacgtgtgaagccctacccactaacgggccatgaggacttgacgtcatcccaccttcctccgt

SEQ ID NO: 1566 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Brevibacteriaceae
aaggccgggaacgtattcaccgcagcgttgctgatctgcgattactagcgactccgacttcacgtagtcgaattgcagactacgatccgaactgagactggctttaagggattcgcttgccctcacgggttcgcctctctctgtaccagccattgtagcatgcgtgaagcccaagacataaagggcatgatgatttgacgtcatccccaccttcctccga

SEQ ID NO: 1567 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggcttttgggattcgctccaccttacggtatcgcagccctttgtaccggccattgtagcatgcgtgaagccctgggacataagggggcatgatgacttgacgtcatccccaccttcctcg

SEQ ID NO: 1568 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgtagtcgagttgcagactacaatccggactacgatacactttctgggattagctccccctcgcgggttggcagccctctgtatgtaccattgtatgacgtgtgaagcctacccataaggggccatgaggacttgacgtcatccccaccttcctccgg

SEQ ID NO: 1569 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcggcatgctgatccgcgattactagcgattccaacttcacgcagtcgagttgcagactgcgatccggactacgatgcactttctgggattagctcccctcgcggttggcggccctctgtatgcaccattgtatgacgtgtgaagccctacccataagggccatgaggacttgacgtcatcccaccttcctccggttt

SEQ ID NO: 1570 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccagcttcatgtaggcgagttgcagcctacaatccgaactgagaatggtttatgggattggcttgacctcgcggtcttgcagccctttgtaccatccattgtagcacgtgtgtagcccaggtcataaggggcatgatgatttgacgtcatcccactacctcccgccg

SEQ ID NO: 1571 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactagacaggcttttttgagattcgctccgcctcacggcttcgcagctcattgtacctgccattgtagcacgtgtgcagcccaagacataagggggcatgatgacttgacgtcgtccccaccttcctcc

SEQ ID NO: 1572 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Propionibacteriaceae
aagccccgggaacgtattcaccgcagcgttgctgatctgcgattactagcgactccgacttcatgaggtcgagttgcagaccccaatccgaactgagaccggctttccgagattcgctcaccctcacaggctcgccactctctgtaccagccattgtagcatgcgtgaagccctgacataaggggcatgatgacttgacgtcatcccaccttcctccgag

SEQ ID NO: 1573 - DNA, 220 bp, Unknown
  Description of Unknown: 16S RNA Operational Taxonomic Unit polynucleotide
  Phylum: Cyanobacteria; Class: Oscillatoriophycideae; Order: Chroococcales; Family: Dermocarpellaceae
aaggcccgggaacggattcaccgcagtatgctgacctgcgattactagcgattccgccttcatgcaggcgagttgcagcctgcaatctgaactgaggcagggtttacgggattagctcgcctcgcgggttgctgccctctgtccctacattgtagtacgtgtgtagcccaggacgtaagggcatgctgacttgactcatcccacttcctccggtttgcac

SEQ ID NO: 1574 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggcccgggaacgaattcactgcagtatgctgacctgcaattactagcgattcctccttcacgaagctgagttgcaagcttcgatctgaactgagctacgatttccgggatttgcttgctatcgctagcttgctgccctctgttcgtagcattgtagtacgtgtgtagcccaagacgtaaggggcatgctgacttgactcatccccaccttctccggtg

SEQ ID NO: 1575 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Moraxellaceae
aaggccgggaacgtattcaccgcggcattctgatccgcgattactagcgattccgacttcatggagtcgagttgcagactccaatccggactacgatcggctttttgagattagcatcctatcgctaggtagcaaccctttgtaccgaccattgtagcacgtgtgtagccctggtcgtaagggccatgatgacttgacgtcgtccccgccttcctccagt

SEQ ID NO: 1576 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggcccggaacgtattcgaccgtatcattgctgatatacgattactagcgattccagcttcatggagtcgagttgcagactccaatctgaactgagaaagagtttttgagattagcgccttgtcgccaagtggcagctctttgtctcttccattgtagcacgtgtgtagccctgggcataaaggccatgatgacttgacatcatcccctcttcctcgcg

SEQ ID NO: 1577 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggctttttccgattcgctcccccctcacgggctcgcaacggtttgtaccggccattgtagcatgcgtgaagccctggacataagggggcatggatgacttgacgtcatccccaccttcct

SEQ ID NO: 1578 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccaggcttcacgtagtcgagttgcagactacgatccggactacgatgcatttctgggattggctccacctcgcggcttggcaaccctctgttccgaccattgtatgacgtgtgaagccctacccataagggccatgaggacttgacgtcatccccacctcctccggt

SEQ ID NO: 1579 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcgactccgacttcatggggtcgagttgcagaccccaatcgaactgagaccggctttttgtagatcgctccacctcacggcttcgcagctcattgtaccggccattgtagcacgtgtgcagcccaagacataaggggcatgatgacttgacgtcgtccccacccttcctccg

SEQ ID NO: 1580 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagacccccaataccggaactgagaccggcttttttgagattcgctccacctcacggtttcgcagctctttgtaccggccattgtagcacgtgtgcagcccaagacataaggggcatgatgacttgacgtcgtcccacttcctc

SEQ ID NO: 1581 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggcttttgggaattcgctccatcttcgcgatttcgcagccctttgtaccggccattgtagcatgcgtgaagccctggacataaggggcatgatgacttgacgtcatccccaccttcctcc

SEQ ID NO: 1582 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcactgctgatctgcgattactagcaactcgacttcatgggggtcgagttgcagaccccaatccgaactgagacaggctttttgagattcgctccgcctcacggcttcgcagctcattgtacctgccattgtagcacgtgtgcagcccaagacataaggggcatgatgacttgacgtcgtccccaccttcctccg

SEQ ID NO: 1583 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaaggggttttttgggattagcgccttgtcgccaagtggcagccctttgtcccctccattgtagcacgtgtgtagccctgggcataaaggccatgatgacttgacatactcccctccttcctcc

SEQ ID NO: 1584 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgagaccggcttataaagattcgctccgcctcgcggcttcgcttcccgttgtaccggccattgtagtacgtgtgtagcccaggtcataaggggcatgatgatttgacgtcatcccaccttcctccggg

SEQ ID NO: 1585 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccaggcttcacgcagtcgagttgcagactgcgatctgaactgagaaggggtttttgggattagctccttgtcgccaagtggcagcccctttgtccttcccattgtagcacgtgtgtagccctggggcataaaggccatgatgacttgacatcatcccctccttcct

SEQ ID NO: 1586 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aatacccgggaacgtattcaccgcggcatgctgatccgcgattactagcgattccagcttcacgtagtcgagttgcagactacgatccggactacgatgcattttctgggattggctccacctcgcggcttggcaaccctctgtatgcaccattgtatgacgtgtgaagccctacccataagggccatgaggacttgacgtcatccccaccttcctccgg

SEQ ID NO: 1587 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccatccgaactgagacaggctttttgtagattcgctccacctcacggtatcgcagctcattgtacctgccattgtagcacgtgtgcagcccaagacataaggggcatgatgacttgacgtcgtcccacctctccggct

SEQ ID NO: 1588 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttctgggattggctccccctcgcgggttggcagccctctgtaccggcccattgtatgacgtgtgtagccctacccataaggggccatgagacctgacgtcatccccaccttcctccg

SEQ ID NO: 1589 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagaccggctttttgagattcgctccacctcacggtttcgcagctcattgtaccggccattgtagcacgtgtgcagcccaagacataaggggcatgatgacttgacgtcacctcaccttcctcccg

SEQ ID NO: 1590 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccagcttcatgtaggcgagttgcagcctacaatccgaactgagaatggttttatgggattggcttgacctcgcggcttgcagcccctttgtaccatccattgtagcacgtgtgtagcccaggtcataaggggcatgatgatttgacgtcatccccaccttcctccgg

SEQ ID NO: 1591 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggctttttgggatttcgctccacctcacggtatcgcagccctttgtaccggcccattgtagcatgcgtgaagccccgggacataagggggcatgatgacttgacgtcatccccaccttcc

SEQ ID NO: 1592 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacgaattcaccgccgtatggctgaccggcgattactagcgattccgccttcatgcaggcgagttgcagcctgcaatctgaactgaggcagggtttacgggattagctcgccctcgcgggttggctgccctctgtccctaccattgtagtacgtgtgtagcccaggacgtaaggggcatgctgacttgacgtcatccccaccttcctccg

SEQ ID NO: 1593 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccggaacgtattcaccgcggcatgctgatccgcgattactagcgattccagcttcacgcagtcgagttgcagactgcgatccgaactgagaacagatttgtgggattggctaaaccttgcggtctcgcagccctttgttctgtccattgtagcacgtgtgtagcccaggtcataaggggcatgatgatttgacgtcatccccaccttctccggtt

SEQ ID NO: 1594 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattcaaacttcatgcagtagagttgcagactgcaatccggactacgatacactttctgggattagctcccccctcgcgggttggcggcccctctgtatgtaccattgtatgacgtgtgaagccctacaataagggccatgaggacttgacgtcatcccccaccttcctcc

SEQ ID NO: 1595 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aaggcccgggaacgtattcaccgcagcgttgctgatctgcgattactagcgactccggacttcatgaggtcgagttgcagacctcaatccgaactgagaccggctttttgggattcgctccaccttacggtatgcagcccctttgtaccggccattgtagcatgcgtgaagcccaagacataaggggcatgatgatttgacgtcatccccaccttcctcc

SEQ ID NO: 1596 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcacggggtcgagttgcagacccccgatccgaactgagaccggctttttgggtattcgctccacctcacggcatcgcaaccctttgtacccggccattgtagcatgcgtgaagccctgggacataagggggcatgatgacttgacgtcatcccaccttcc

SEQ ID NO: 1597 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttctgggattgggctcccctcgcgggttgggcagccctcctgtaccggcccattgtatgacgtgtgtagccctacccataagggccatgaggacctgacgtcatccccacccttcct

SEQ ID NO: 1598 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggcccgggaacgtattcaccgcagcgttgctgatctgcgattactagcgactccgacttcacggggtcgagttgcagaccccgatccgaactgagaccagcttttgggattcgctcccaccttacggtctcgcagccctttgtactggccattgtagcatgcgtgaagcccaagacataaggggcatgatgatttgacgtcatccccaccttcctccc

SEQ ID NO: 1599 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagaaggtttttgggattagctccttgtcgccaagtggcagcccctttgtccttccattgtagcacgtgtgtagccctgggcataaaggccatgatgacttgacatcatcccccttcctcacgt

SEQ ID NO: 1600 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Moraxellaceae
aaggcccgggaacgtattcaccgcggcattctgatccgcgattactagcgattccgacttcatggagtcgagttgcagactccaatccggactacgattccggcttttttgagattagcatcctatcgctaggtagcaaccctttgtaccgaccattgtagcacgtgtgtagccctggtcgtaaggggccatgatgacttgacgtcgtccccgcttcctc

SEQ ID NO: 1601 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcacggggtcgagttgcagaccccgatccgaactgagaccgcttttgggtagttcgctccacctcacggcatcgcaaccctttgtaccggccattgtagcatgcgtgaagccctggacataaggggcgatgatgacttgacgtcatccccaccttcctcc

SEQ ID NO: 1602 - DNA, 220 bp, Unknown
  Description of Unknown: 16S RNA Operational Taxonomic Unit polynucleotide
  Phylum: Firmicutes; Class: Bacilli; Order: Bacillales; Family: Staphylococcaceae
aatacccgggaacgtattcaccgtagcatgctgatctacgattactagcgattccagcttcatgtagtcgagttgcagactacaatccgaactgagaacaactttatgggatttgcttgacctcgcggtttcgctaccctttgtattgtccattgtagcacgtgtgtagcccaaatcataaggggcatgatgatttgacgtcatccccaccttcctccgg

SEQ ID NO: 1603 - DNA, 220 bp, Unknown
  Description of Unknown: 16S RNA Operational Taxonomic Unit polynucleotide
  Phylum: Firmicutes; Class: Bacilli; Order: Lactobacillales; Family: Streptococcaceae
aagacccgggaacgtattcaccgcggcgtgctgatccgcgattactagcgattccgacttcatgtaggcgagttgcagcctacaatccgaactgagactggctttaagagattagcttgccgtcaccgacttgcgactcgttgtaccagccattgtagcacgtgtgtagcccagggtcataaggggcatgatgatttgacgtcatccccaccttcctccg

SEQ ID NO: 1604 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacggattcaccgcagtatgctgacctgcgattactagcgattccgccttcatgcaggcgagttgcagcctgcaatctgaactgaggggcagggttttacgggattagctcgccctcgcgggttggctgccctctgtccctaccattgtagtacgtgtgtagcccaggacgtaaggggcatgctgacttgacgtcatccccaccttcctc

SEQ ID NO: 1605 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagaccggaacgtattcaccgcggcatgctgatccgcgattactagcgattccagcttcacgcacccgagttgcagagtgcgatccggactacgaccggtttctgggattggctccacctcgcggcttggctacccctctgttccgaccattgtatgacgtgtgaagccctacccataaggggccatgaggacttgacgtcatccccaccttcctccggt

SEQ ID NO: 1606 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcacggggtcgagttgcagaccccgatccgaactgagaccggctttttggggtattcgctccacctcacggtatcgcagcccctttgtacccggccattgtagcatgcgtgaagccctggacagtaaggggggcatgatgacttgacgtcatccccacct

SEQ ID NO: 1607 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Moraxellaceae
aaggcccgggaacgtattcaccgcggcattctgatccgcgattactagcgattccgacttcatggagtcgagttgcagactccaatccggactacgatcggctttttgagattagcatcctatcgctaggtagcaaccccttgtaccgaccattgtagcacgtgtgtagccctggtcgtaaggggccatgatgacttgacgtcgtcccgcctcctccacg

SEQ ID NO: 1608 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aagacccgggaacgtattcaccgcgacattctgattcgcgattactagcgattccgacttcacgcagtcgagttgcagactgcgatccggactacgatcggtttatgggattagctccacctcgcggcttggcaaccctctgtaccgaccattgtagcacgtgtgtagcccaggccgtaagggccatgatgacttgacgtcatccccacctcctccgttg

SEQ ID NO: 1609 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgcgaagggtcgccccttagcatcccactgccaccgccattgtagcacgtgtgtagcccagcccgtaagggccatgaggacttgacgtcatccccaccttcctccggc

SEQ ID NO: 1610 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Propionibacteriaceae
aaggctcgggaacgtattcaccgcagcgttgctgatctgcgattactagcgactccgacttcatggggtcgagttgcagaccccaatccgaactgagactggctttttgggattcgctcgaccttgcggttttgcagccctttgtaccagccattgtagcatgcgtgaagccctggacttaaggggcatgatgacttgacgtcatccccaccttcctccg

SEQ ID NO: 1611 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagaccggaacgtattcaccgtgacattctgatccacgattactagcgattccgacttcacgcagtcgagttgcagactgcgatccggactacgaccggttttatgggattagctccccctcgcgggttggcaaccctttgtaccagccattgtatgacgtgtgtagccccacctataagggccatgaggacttgacgtcatccccaccttcctccggtt

SEQ ID NO: 1612 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micrococcaceae
aaggcccggaacgtattcaccgcagcgttgctgatctgcgattactagcgactccgacttcatggggtcgagttgcagaccccaatccgaactgagaccggctttttgggattagctccacctcacagtatcgcaaccctttgtaccggccattgtagcatgcgtgaagcccaagacataaggggcatgatgatttgacgtcgtcccaccttcctccgag

SEQ ID NO: 1613 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttctgggattggctccccctcgcgggttggcgaccctctgtaccggccattgtatgacgtgtgtagccctacccataagggccatgaggacctgacgtcatccccacctttcccccc

SEQ ID NO: 1614 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccaacttcatggggtcgagttgcagaccccaatccgaactgagacggctttttgagatttgcgaagggtcgcccctttgcatcctctgtcaccgccattgtagcacgtgtgtagcccagccgtaagggccatgaggacttgacgtcatccccaccttcctcccggct

SEQ ID NO: 1615 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggcttttgggatttgctcactctcgcgagtttgctgcccattgtcaccgccattgtagcacgtgtgtagcccagcgcgtaagggccatgaggacttgacgtcacctccctaccttccgtcgg

SEQ ID NO: 1616 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagacccgggaacgtattcaccgtgacattctgatccacgattactagcgattccgacttcacgcagtcgagttgcagactgcgatccggactacgaccggttttatgggattagctcccccctcgcgggttggcagcctttgtaccggccattgtatgacgtgtgtagccccacctataagggccatgaggacttgacgtcatcccccacccttcctcc

SEQ ID NO: 1617 - DNA, 220 bp, Unknown
  Description of Unknown: 16S RNA Operational Taxonomic Unit polynucleotide
  Phylum: Armatimonadetes; Class: Chthonomonadetes; Order: Chthonomonadales; Family: Chthonomonadaceae
aaggtccgggaacgtattcaacgcagtttagctgacctgcgtttactagcgattccggcttcatgcaggcgagttgcagcctgcaatccgaactgagaacggatttctgagattgcctccacctcacggtctcggatccctctgtttaccgtccattgtagcatgtttgtagcccaggatgtaagggccatgctgacttgacgtcatcctcaccttcctc

SEQ ID NO: 1618 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggcccgggaacgtattcgaccgcgacattctgattcgcgattactagcgattccgacttcacgcagtcgagttgcagactgcgatccggactacgattcggtttttatgggattagctccacctcgcggcttggcaaccctttgtaccgaccattgtagcacgtgtgtagcccaggccgtaagggccatgatgacttgacgtcatccccaccttcctc

SEQ ID NO: 1619 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggctttttggattcgctctatcttgcgatttcgcagccctttgtaccggccattgtagcatgcgtgaagccctaggcataaggggcatgatgacttgacgtcatccccacttcctccggt

SEQ ID NO: 1620 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggcccgggaacgtattcaccgtgacattctgattcacgattactagcgattccgacttcacgcagtcgagttgcagactgcgatccggactacgatcggttttatgggatttagcctccacctcgcggcttggcaaccctttgtaccgaccattgtagcacgtgtgtagcccaggccgtaagggccatgatgacttgacgtcatccccaccttcctcc

SEQ ID NO: 1621 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggctttttgggattcgctccacctcgcggtttagcagccctttgtaccggccattgtagcatgtgtgcagcccaagacataaggggcatgatgatttgacgtcatccccacttcctcccg

SEQ ID NO: 1622 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccggcttcatgtaggcgagttgcagcctacaatccgaactgagaatggttttatgggattggctagaccttgcggttttgcagccctttgtaccatccattgtagcacgtgtgtagcccaggtcataaggggcatgatgatttgacgtcatccccaccttcctccga

SEQ ID NO: 1623 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggcttttggagattagctcacctcgcgggtttgcgccctctgtcaccgccattgtagcacgtgtgtagcccagcgcgtaaggccatgaggacttgacgtcatccccacttcctccggcttat

SEQ ID NO: 1624 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Rhizobiaceae
aaggcccgggaacgtattcaccgcggcatgctgatccgcgattactagcgattccaacttcatgcactcgagttgcagagtgcaatcccgaacttgagatggcttttggacgattagctcgacatcgctgtctcgctgcccactgtcaccaccattgtagcacgtgtgtagcccagcccgtaagggccatgaggacttgacgtcatccccacttcctctc

SEQ ID NO: 1625 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Brucellaceae
aaggcccgggaacgtattcaccgcggcatgctgatccgcgattactagcgattccaacttcatgcactcgagttgcagagtgcaatccgaactgagatggcttttggagattacgctcacactcgcgtgctcgctgcccactgtcaccaccattgtagcacgtgtgtagcccagcccgtaagggccattgaggcttgacgtcatccccacttcctctcgc

SEQ ID NO: 1626 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcatgctgatccacgattactagcgattccaacttcatgggctcgagttgcagagcccaatccgaactgagacggctttttgagtatttgcgaagggttgcccccttagcgtcccattgtcaccgccattgtagcacgtgtgtagcccagcccgtaagggccatgaggacttgacgtcatccccaccttctcgcg

SEQ ID NO: 1627 - DNA, 220 bp, Unknown
  Description of Unknown: 16S RNA Operational Taxonomic Unit polynucleotide
  Phylum: Proteobacteria; Class: Deltaproteobacteria; Order: Syntrophobacterales; Family: Syntrophobacteraceae
aaggcccggaacgtatcgaccgcgggcgtgctgatccgcgattactagcgattccaacttcatggagtcgagttgcagactccaatccgaactgagagcggctttttgggattagctccccctcgcgggtttgcaaccctttgtaccgcccattgtagcacgtgtgtggccctggacataagggccatgatgacttgacgtcgtccccaccttcctccgg

SEQ ID NO: 1628 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgcagtcgagttgcagactgcaatccggactacgacgcgctttaagggattggctccacctcgcggcttggcaaccctctgtaccggccattgtatgacgtgtgaagccctaccataagggccatgaggacttgacgtcatccccaccttcctccggt

SEQ ID NO: 1629 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccagcttcacgcagtcgagttgcagactgcgatccggactacgatcggttttctgggattggctccacctcgcggcttagcgaccctctgttccgaccattgtatgacgtgtgaagccctacccataagggccatgaggacttgactcatccccaccttcctccggt

SEQ ID NO: 1630 - DNA, 220 bp, Unknown
  Description of Unknown: 16S RNA Operational Taxonomic Unit polynucleotide
  Phylum: Proteobacteria; Class: Gammaproteobacteria; Order: Enterobacteriales; Family: Enterobacteriaceae
aaggcccgggacgtattcaccgtagcattctgatctacgattactagcgattccgacttcatggagtcgagttgcagactccaatccggactacgacgcactttatgaggtccgcttgctctcgcgagttcgcttctctttgtatgcgccattgtagcacgtgtgtagccctactcgtaagggccatgatgacttgacgtcatcccccttcctccagtta

SEQ ID NO: 1631 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Phyllobacteriaceae
aaggcccgggaacgtattcaccgtggcatgctgatccacgattactagcgattccgacttcatgctctcgagttgcagagaacaatccgaactgagacggctttttgggaattaggctcctcctcgcggagtggctgcccactgtcaccgccattgtagcacgtgtgtagcccagcccgtaagggccatgatgacttgacgtcatccccaccttcctccg

SEQ ID NO: 1632 - DNA, 220 bp, Unknown
  Description of Unknown: 16S RNA Operational Taxonomic Unit polynucleotide
  Phylum: Acidobacteria; Class: Acidobacteria; Order: Acidobacteriales
aggcccgggacgtattcaccgcggcgtgctgatccgcgattactagcgattccaacttcatgcaggcgagttgcagcctgcaatccgaactgagaccggctttctccgattagctccaccttgcggtatcgcgacggtttgtaccggccattgtagcacgtgtgtagccccagacataaaggccatgctgacttgacgtcatccccacttcctccggttt

SEQ ID NO: 1633 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
agggtccgggaacgtattcaccgtagcgttgctgatctacgattactagcgattccagcttcatggagtcgagttgcagactccaatctgaactgagaagtggtttttggattagcttcatatcactatgttgcagccctttgtccactccattgtagcacgtgtgtagccctgggcataaaggccatgatgacttgacatcatcccctcttcctcacgt

SEQ ID NO: 1634 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcggcgtgctgatccgcgattactagcgattccagcttcatggagtcgagttgcagactccaatccgaactgaggccggctttttccgattagctccccttcgcaggtttgcgacggtttgtaccgaccattgtagcacgtgtgtagccctggacataaaggccatgaggacttgacgtcatcccaccttcctcccta

SEQ ID NO: 1635 - DNA, 220 bp, Unknown
  Description of Unknown: 16S RNA Operational Taxonomic Unit polynucleotide
  Phylum: Proteobacteria; Class: Betaproteobacteria
aagaccagggaacgtattcaccgcgacatgctgatccgcgattactagcgattccgacttcatgcagtcgagttgcagactgcaatccggactacgaccggcttttatggggattggctccagctcgcgctttggcaaccctctgtaccggccattgtatgacgtgtgaagccctacccataagggccatgaggacttgacgtcatccccaccttcctcc

SEQ ID NO: 1636 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Phyllobacteriaceae
agggcccgggaacgtattcaccgcggcacgctgatccgcgattactagcgattccgacttcatgctctcgagttgcagagaacaatccgaactgagacggctttttggttagcgcctcctcgcggagtggctgcccattgtcaccgccattgtagcacgtgtgtagcccagcccgtaagggccatgatgacttgacgtcatccccaccttcctccggctt

SEQ ID NO: 1637 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Frankiaceae
aaggcccgggaacgtattcaccgcagcgttgctgatctgcgattactagcgactccgacttcatggggtcgagttgcagaccccaatccgaactgagaccggctttattgagattcgctccaccttgcggtatcgcagctctttgtaccggccattgtagcatgtgtgcagccctggacataaggggcgatgatgacttgacgtcatccccaccttcctc

SEQ ID NO: 1638 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Mycobacteriaceae
aaggcccgggaacgtattcaccgcagcgttgctgatctgcgattactagcgactccgacttcacggggtcgagttgcagaccccgatccgaactgagaccggctttgaaaggattcgctccacctcaggcatcgcagccctttgtaccggccattgtagcatgtgtgaagccctggacataaggggcatgatgacttgacgtcatccctccttcctcacg

SEQ ID NO: 1639 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaagacccgggaacgtattcaccgtggcatgctgatccacgattactagcgattccagcttcatgtaggcgagttgcagcctacaatccgaactgagaatggtttatgggattggctcgacctcgcggttttgcagccctttgtaccatccattgtagcacgtgtgtagcccaggtcataaggggcatgatgatttgacgtcatccccaccttcctccgg

SEQ ID NO: 1640 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacaagctttttgcgattggctcccccttgcaggtttgcagcgctttgtacttgccattgtagcacgtgtgtagccctggacattaaaggccatgacggactttgacgtcatccccaccttcctc

SEQ ID NO: 1641 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccggacgtattcaccgcagcaatgctgatctgcgattactagcgattccgacttcatggagtcgagttgcagactccaatccggactgagagaaggttctgggattggctcaccctcgcgggattgcagccctctgtccttcccattgtagtacgtgtgtagccctggccgtaagggccatgatgacttgacgtcatccccacttcctccggttt

SEQ ID NO: 1642 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatctgaactgagaagtgttttttgagattggcttcacgtcaccgtgttgctgctctttgtacactccattgtagcacgtgtgtagccctgggcataaaggccatgatgacttgacatcatcccccttcctcacgt

SEQ ID NO: 1643 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgtggcatgctgatccacgattactagcgattccgccttcatgctctcgagttgcagagaacaatccgaactgagacggcttttggggatttgctcactctcgcgagtttgcagcccactgtcaccgccattgtagcacgtgtgtagcccagcgcgtaagggccatgaggacttgacgtcatccccactcctccggctt

SEQ ID NO: 1644 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccaacttcatggggtcgagttgcagaccccaatccgaactgagacggatttttgagatttgcgaagggtcgcccctttgcatccctctgtcaccgccattgtagcacgtgtgtagcccaccccgtaagggccatgaggacttgacgtcatccccacttctccgatta

SEQ ID NO: 1645 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcatgcaggcgagttgcagcctacaatccgaactgagacaggctttctccgattagctccaccttgcggtctcgcgacggtttgtacctgccattgtagcacgtgtgtggccccagacataaggccatgatgacttgacatcatcccctccttcctcacgt

SEQ ID NO: 1646 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggcccgggaacgaattcactgcagtatgctgacctgcaattactagcgattcctccttcacgcaggcgagttgcagcctgcgatctgaactcgagctccggtttaccgggatttggcttgcattcgcatgcttgctgccctctgtccggagcattgtagtacgtgtgtagcccaaggcgtaaggggcatgctgacttgacgtcatccccaccttcctc

SEQ ID NO: 1647 - DNA, 220 bp, Unknown
  Description of Unknown: 16S RNA Operational Taxonomic Unit polynucleotide
  Phylum: Acidobacteria; Class: Chloracidobacteria
acaagacccgggaacgtattcaccgcagcatgctgatctgcgattactagcgattccagcttcatggagtcgagttgcagactccaatccgaactgagacaagcttttgcgattggctcccctttgcaggtttgcagcgctttgtacttgccattgtagcacgtgtgtagccctggacataaaggccatgaggacttgacgtcatccccaccttcctccg

SEQ ID NO: 1648 - DNA, 220 bp, Unknown
  Description of Unknown: 16S RNA Operational Taxonomic Unit polynucleotide
  Phylum: Proteobacteria; Class: Betaproteobacteria
aaggcctgggaacgtattcaccgcgacatgctgatccgcgattactagcgattccgacttcatgcagtcgagttgcagactgcaatccggactacgacgcgctttaagggattggctctacctcgcggcttagcaggccctctgtacgcgccattgtattacgtgtgaagccctacccataagggccatgaggacttgacgtcatccccaccttcctccg

SEQ ID NO: 1649 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccggaacggtattcaccgtatcattgctgatatacgattactagcgattccagcttcatggagtcgagttgcagactccaatctgaactgagaggcgttttttgggtattggctccttatcgctaagtggcagcccttttgtacgccccattgtagcacgtgtgtagccctgggcataaaggccatgatgacttgacatcatcccctccttcctc

SEQ ID NO: 1650 - DNA, 220 bp, Unknown
  Description of Unknown: 16S RNA Operational Taxonomic Unit polynucleotide
  Phylum: Proteobacteria; Class: Alphaproteobacteria
aaaggcccgggaacgtattcaccgcagcctgctgttctgcgattactagcgattccaccttcatgtactcgagttgcagagtacaatctgaactgggacggttttttgggattagccgcttctcgcgaagtagctgcccactgtcaccgccattgtagcacgtgtgtagcccagggtgtaagggccatgaggacttgacgtcatccccacttcctccggc

SEQ ID NO: 1651 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgctctcgagttgcagagaacaatccgaactgagacggtttttgggagtttgctcactctcgcgagtttgctgcccactgtcaccgccattgtagcacgtgtgtagcccagcgcgtaagggccatgaggacttgacgtcatccccaccttccccggcg

SEQ ID NO: 1652 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcatgctgatccgcgattactagcgattccgacttcatgcagtcgagttgcagactgcaatccggactacgaccggctttctgggattggcctccccctcgcgggttggcaaccctctgtaccggccattgtatgacgtgtgaagccctacccataagggccatgaggacttgacgtcatccccactctccggtt

SEQ ID NO: 1653 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
acaaggcccgggaacgtattcacggcgtcgtagctgatacgccattactagcgattccggcttcatgaagtcgagttgcagacttcaatctgaactgggcccagttttagagatttcctccacctcgcggtcttggatcgttctgtgctgggcattgtagtacgtgtgcagcccaggccgtaagggccatactgacttgacgtcgtccccaccttcctcc

SEQ ID NO: 1654 - DNA, 220 bp, Unknown
  Description of Unknown: 16S RNA Operational Taxonomic Unit polynucleotide
  Phylum: Acidobacteria; Class: Chloracidobacteria
acaagacccgggaacgtattcaccgcaacattctgatttgcgattactagcgattccaacttcatggagtcgagttgcagactccaatccgaactgagatcggtttttgcgattggctccccctcgcgggattgcgacgctttgtaccgaccattgtagcacgtgtgtagccctgaacataaaggccatgatgacttgacatcatccccaccttcctccg

SEQ ID NO: 1655 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
acggcccgggaacgtattcaccgcggcatgctgatccgcgattactagcgattccagcttcatgtaggcgagttgcagcctacaatccgaactgagaacggttttatgagattagctccacctcgcggtcttgcaactctttgtaccgtccattgtagcacgtgtgtagcccaggtcataaggggcatgatgatttgacgtcatccccaccttcctccgg

SEQ ID NO: 1656 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaaggtccgggaacgtattcaccgtagcattgctgatctacgattactagcgattccagcttcatggggtcgagttgcagaccccaatctgaactgagacgaggtttttgagattagcatccagttacctggtagcagccctttgtcctcccattgtagcacgtgtgtagccctgggcataaaggccatgatgacttgacatcatcccctcttcctcacg

SEQ ID NO: 1657 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccagcttcacgtagtcgagttgcagactacgatccggactacgatgcgttttctgggattggctcccccctcgccgggttggcaaccctctgtacgcaccattgtatgacgtgtgaagccctacccataagggccatgaggacttgacgtcatccccaccttcctcc

SEQ ID NO: 1658 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgcagtcgagttgcagactgcaatctgaactgagagtgctttttgggattagctccttgtcaccaagtggcagccctttgtagcacccattgtagcacgtgtgtagccctgggcataaaggccatgatgacttgacatcatcccctccttcctcgcg

SEQ ID NO: 1659 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatctgaactgagagacgttttttgggattagcttcacgtcaccgtgttgctgccctttgtacgtcccattgtagcacgtgtgtagccctggcataaaggccatgatgacttgacatcatcccctccttcctcgcg

SEQ ID NO: 1660 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcggcgttctgatccgcgattactagcgattccaacttcatgaagtcgagttgcagacttcaatccgaactgagaccggtttttgcgattagcctccccctttacgggattgcgacgttttgtaccggccattgtagcacgtgtgtagccctaagcataaaggccatgatgacttgacatcatccccaccttcctccg

SEQ ID NO: 1661 - DNA, 220 bp, Unknown
  Description of Unknown: 16S RNA Operational Taxonomic Unit polynucleotide
  Phylum: Proteobacteria; Class: Betaproteobacteria; Order: Rhodocyclales
aagacccgggaacgtattcaccgcgacattgctgatccgcgattactagcgattccgacttcatgcagtcgagttgcagactgcaatccggactacgacgcactttctgggattggctccccctcgcgggttggcagccctctgtatgcgccattgtatgacgtgtgaagccctacccataagggccatgaggacttgacgtatccacctctccgtccgt

SEQ ID NO: 1662 - DNA, 220 bp, Unknown
  Description of Unknown: 16S RNA Operational Taxonomic Unit polynucleotide
  Phylum: Proteobacteria; Class: Betaproteobacteria
atgacccgggaacgtattcaccgcgacatgctgatccgcgattactagcgattccgacttcatgcagtcgagttgcagactgcaatccggactacgaccggctttctgggattggctccgcctcgcggcttggcaaccctctgtaccggccattgtatgacgtgtgaagccctacccataagggccatgaggacttgacgtcatccccacttcctccggt

SEQ ID NO: 1663 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggctttttgggattgctcaccctcgcgagtttgctgcccattgtcaccgccattgtagcacgtgtgtagcccagcgcgtaagggccatgaggacttgacgtcattccccaccttcctccggg

SEQ ID NO: 1664 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccctcgggttgcagaggacaatccgaactgaggacgggtttgtcgggattggctccgggtttccccctcgcgaccctctgtcccgtccattgtagcacgtgtgtagccctggacgtaaggacccatgataggacttgacgtcgtccccaccttcc

SEQ ID NO: 1665 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Intrasporangiaceae
aaggcccgggaacgtattcaccgcagcgttgctgatctgcgattactagcgacttccgacttcatggggtcgagttgcagaccccaatccgaactgagaccggttttttgggatttcgctccacctcgcggtttcgcagccctttgtaccggccattgtagcatgcgtgaagcccaagacataaggggcatgatgatttgacgtcatcccccaccttcct

SEQ ID NO: 1666 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcgtgctgatctgcgattactagcgattccagcttcatggagtcgagttgcagactccaatccgaactgagacaagctttttgcgattggctccctctcgcgagtttgcagcgctttgtacttgccattgtagcacgtgtgtagccctggacataaaggccatgagggactttgacgtcatccccaccttcctcc

SEQ ID NO: 1667 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgttttttgggattagcttcatatcgctatgttgcagccctttgtacgccccattgtagcacgtgtgtagccctgggcataaaggccatgatgactgacatcaatcccctcttcctcacg

SEQ ID NO: 1668 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
acaaggtccgggaacgtattcaccgtagcgttgctgatctacgattactagcgattccagcttcatgcaggcgagttgcagcctgcaatctgaactgagagaaggtttttgagattggcgccctgtcaccaggtggcagctctttgtccttcccattgtagcacgtgtgtagccctgggcataaaggccatgatgacttgacatcatcccctccttcctc

SEQ ID NO: 1669 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcaagcaggcgagttgcagcctgctatccgaactgagaccggctttctccgattagctcccccttgcgggctcgcgacggtttgtaccggccattgtagcacgtgtgtagccccagacataaaggccatgctgacttgacgtcatccccaccttcctcccc

SEQ ID NO: 1670 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgcagtcgagttgcagactgcaatccggactacgaccggctttctgggattggctccagctcgcgctttggcaaccctctgtaccggccattgtatgacgtgtgaagcctacccaataagggccatgaggacttgacgtcatcccaccttcctccggt

SEQ ID NO: 1671 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aaagacccgggaacgtattcaccgtgacatcgctgattcacgattactagcgattccgacttcacgcagccgagttgcagactgcgatccggactacgaccggctttttgggattggctccccctcgcgggttggcaaccctttgtaccggccattgtagcacgtgtgtagccctggtcataagggccatgatgacttgacgtcatccccacttcctccg

SEQ ID NO: 1672 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgtgctgatctgcgattactagcgattccagcttcatggagtcgagttgcagactccaatccgaactgaggccggctttttccgattagctccccctcgcgggtttgcgacagtttgtaccgaccattgtagcacgtgtgtggccctggacataaaggccatgaggacttgacgtcatcccccaccttcctcca

SEQ ID NO: 1673 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggctttttgggattcgctccaccttacagtttcgcagccctttgtaccggccattgtagcatgcgtgaagccctggaccataagggcatgatgacttgacgtcatccccacttcctccga

SEQ ID NO: 1674 - DNA, 220 bp, Unknown
  Description of Unknown: 16S RNA Operational Taxonomic Unit polynucleotide
  Phylum: Firmicutes; Class: Bacilli; Order: Bacillales
aaggcccgggaacgtattcaccgcggcatgctgatccgcgattactagcgattccagcttcatgtaggcgagttgcagcctacaatccgaactgtagaatggtttatgggattggcttgacctcgcggtcttgcagcccttgtaccatccattgtagcacgtgtgtagcccaggtcataaggggcatgatgactttgaccgtcatccccaccttcctccg

SEQ ID NO: 1675 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgttctgatctgcgattactagcgattccagcttcatggagtcgagttgcagactccaatccgaactgaggtcggctttttccgattagctccccctcgcgggtttgtcgacggtttgtaccgaccattgtagcacgtgtgtagccctggacataaaggccatgagggacttgacgtcatcccccacccttcct

SEQ ID NO: 1676 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagacgtttttgagattggcttcacatcgctgtgttgctgctctttgtacgtcccattgtagcacgtgtgtagccctgggcataagggccatgatgacttgacgtcatccccaccttcctccgg

SEQ ID NO: 1677 - DNA, 220 bp, Unknown
  Description of Unknown: 16S RNA Operational Taxonomic Unit polynucleotide
  Phylum: Proteobacteria; Class: Betaproteobacteria
aagaccggaacgtattcaccgcgacatgctgatccgcgattactagcgattccgacttcatgcagtcgagttgcagactgcaatccggactacgaccggcttttatggggattggctccgcctcgcggcttggcaaccctctgtaccggccattgtatgacgtgtgaagccctaccataagggccatgaggacttgacgtcatccccaccttctccggtt

SEQ ID NO: 1678 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagacccgggaacgtattcaccgcgacattctgatccgcgattactagcgattccgacttcacgtagtcgagttgcagactacgatccggactacgactggttttatgggattagctcccctcgcgggttggcaacctctgtaccagccattgtatgacgtgtgtagccctacctataagggccatgaggacttgacgtcatccccaccttctccggttt

SEQ ID NO: 1679 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcgaccgcagcaatgctgatctgcgattactagcaactccgacttcatgggggtcgattgcagaccccaatccgaactgagacaggcttttttgagattcgctccacctcacggtatcgcagctcattgtacctgccattgtagcacgtgtgcagcccaagacataaggggcatgatgacttgacgtcgtccccaccttcctc

SEQ ID NO: 1680 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcacgcagtcgagttgcagactgcgatccggactacgatactactttctgggattagcctccccctcgcgggttggcggccctctgtatgtaccattgtatgacgtgtgaagccctacccataagggccatgaggacttgacgtccatcccccaccttcct

SEQ ID NO: 1681 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgtttttgggattagcttcatatcgctatgttggcagcccctttgtacgccccattgtagcacgtgtgtagccctgggcataaaggccatgatgacttgacatcatcccctccttcctca

SEQ ID NO: 1682 - DNA, 220 bp, Unknown
  Description of Unknown: 16S RNA Operational Taxonomic Unit polynucleotide
  Phylum: Verrucomicrobia; Class: Opitutae; Order: Opitutales; Family: Opitutaceae
aaggcccggaacgtattcacggcgccgtagctgatgcgccattactagcgattccaacttcatgtagtcgagttgcagactacaatctgaactgggcccggttttgaggattgctccacctcgcggtattgcttccctctgtaccgggcattgtagtacgtgtgcagccctggccgtaagggccatcctgacttgacgtcatccccaccttcccaccctc

SEQ ID NO: 1683 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
agggtccgggaacgtattcaccgtatcattgctgatatacgattactagcgattccagcttcatgcaggcgagttgcagcctgcaatctgaactgagaagagtttttgggattggctccttgtcaccaagtggcagccctttgtactctccattgtagcacgtgtgtagccctgggcataaaggccatgatgacttgacatcatcccctccttcctcgcg

SEQ ID NO: 1684 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcaacatgctgatttgcgattactagcgattccaacttcatgaagtcgagttgcagacttcaatccgaactgagaccggttttagcgattggctccccttgcgggattgcgacgtttgtaccggccattgtagcacgtgtgtagccctgaacataaaggccatgatgacttgacatcatccccactcctccgtttatc

SEQ ID NO: 1685 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aagcccgggaacgtattcaccgcagcgttgctgatctgcgattactagcgactccaacttcacggggtcgagttgcagaccccgatccgaactgagacccactttaagggattcgctccacctcacggtctcgcagccctctgtataggccattgtagcatgtgtgaagccctggacataaggggcatgatgacttgacgtcatccccaccttcctccga

SEQ ID NO: 1686 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccggaacgtattcaccgcagcgttgctgatctgcgattactagcgactccgacttcatggggtcgagttgcagaccccaatccgaactgagaccggctttttgggatcgctccgccttacagcatcgcagccctttgtaccggccattgtagcatgcgtgaagccctggacataaggggcatgatgacttgacgtcatccccaccttcctccgag

SEQ ID NO: 1687 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccgtcgggttgcagacgacaatccgaactgaggcggggtttacggggattggtcttgccgttgccggctcgcagccctttgtccccgccattgtagcacgtgtgtagccctagacgtaaggaccatgatgacttgacgtcgtccccaccttcctc

SEQ ID NO: 1688 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggcccgggaacgtattcaccgtggcgtgctgatccacgattactagcgattccaacttcatgcactcgagttgcagagtgcaatccgaactgagacggcttttagggatagcatgtctcgcggactagctgccctctgtcaccgccattgtagcacgtgtgtagccagcccgtaagggccatgaagacttgacgtcatccccaccttcctccggctta

SEQ ID NO: 1689 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcgacgttgctgattcgcgattactagcgactccgacttcatggggtcgagttgcagaccccaatccgaactgagaccagcttttttgggtagttcgctccaccttgcggtctcgcaaccctttgtactggccattgtagcatgtttgcagcccaagacataaggggcgatgaggacttgacgtcatccccaccttcc

SEQ ID NO: 1690 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcatgctgatccgcgattactagcgattccgacttcatgcagtcgagttgcagactgcaatccggactacgaccggctttctgggattcggctcccccgtcgcgggttggcaaccctctgtaccggccattgtatgacgtgtgaagccctaccataagggccatgaggacttgacgtcatccccaccttcctccg

SEQ ID NO: 1691 - DNA, 220 bp, Unknown
  Description of Unknown: 16S RNA Operational Taxonomic Unit polynucleotide
  Phylum: Acidobacteria; Class: Chloracidobacteria
aagaccccgggaacgtattcaccgcagcattctgatctgcgattactagcgattccaacttcatgaagtcgagttgcagacttcaatccgaactgagaccggtttttgcgattagctcccctcttacgagattgcgacgttttgtaccggccattgtagcacgtgtgtagccctaagcataaaggccatgatgacttgacatcatccccaccctccgttt

SEQ ID NO: 1692 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggcccgggaacgtattcaccgtatcattgctgatatacgattactagcgattccagcttcatggggtcgagttgcagaccccaattcgaactgagacgagttttttgagattagcatcctgttaccaggtagctgccctttgtactcgccattgtagcacgtgtgtagccctgggcataaaggccatgatgacttgacatcatcccctccttcccccg

SEQ ID NO: 1693 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgcactcgagttgcagagtgcaatccgaactgagacaacttttggagattagctcaccctcgcgggattgctgcccactgtagttgccattgtagcacgtgtgtagcccataagggccatgaggacttgacgtcatccccaccttcctccggcttgtc

SEQ ID NO: 1694 - DNA, 220 bp, Unknown
  Description of Unknown: 16S RNA Operational Taxonomic Unit polynucleotide
  Phylum: Chloroflexi; Class: Anaerolineae; Order: envOPS12
gaggcccgagaacgtattcaacgcactatagctgacgcgcgtttactagcaactccggcttcatgcaggcgagttgcagcctgcaatctgaactgaggacagttttgggggattggctccacctcgcggcttagcaacccattgtactgcccattgtagcgtgtgtgtagccccaggcataaaggccatgctgacttgacgtcatccccaccttcctccg

SEQ ID NO: 1695 - DNA, 220 bp, Unknown
  Description of Unknown: 16S RNA Operational Taxonomic Unit polynucleotide
  Phylum: Actinobacteria; Class: Actinobacteria; Order: MC47
aaggcccgagaacgcattcaccgcggcgttgctgatccgcgattactagcaactccgccttcatggaggcgagtttcagcctccaatccgaaccgggaccggcttttttgggatttcgctccccctcacgggtttgcagccctctgtaccggccaatgtagcacgtgtgtagcccgagacgtaaggggcatgatgacttgacatcatccccacttcctcc

SEQ ID NO: 1696 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcgttctgatctgcgattactagcgattccaacttcatgaagtcgagttgcagacttcaatccgaactgagaatggttttcgcgattagctccctcttacgagattgcgacgttttgtaccatccattgtagcacgtgtgtagccctaagcataaaggccatgatgacttgacatcatccccactctccgtttat

SEQ ID NO: 1697 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggcccgggaacgtattcaccgcagcattgctgatctgcgattactagcgactccgacttcacggggtcgagttgcagaccccgatccgaactgagacccactttaagggattcgctccacctcacggtctcgcagccccttctgtatgagcccattgtagcatgtgtgaagccctggacataaggggcatgatgacttgacgtcatccccacttcctc

SEQ ID NO: 1698 - DNA, 220 bp, Unknown
  Description of Unknown: 16S RNA Operational Taxonomic Unit polynucleotide
  Phylum: Acidobacteria; Class: Chloracidobacteria
aagactcgggaacgtattcaccgcagcatgctgatctgcgattactagcgattccagcttcatggagtcgagttgcagactccaatccgaactgagacaagctttttccgattggctccccattgctggtttgcagcggtttgtacctgccattgtagcacgtgtgtagccctggacataaaggccatgaggacttgacgtcatccccaccttcctccgt

SEQ ID NO: 1699 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Mycobacteriaceae
aaggcccgggaacgtattcaccgcagcgttgctgatctgcgattactagcgactccgacttcacggggtcgagttgcagaccccgatccgaactgagaccggctttaaaaggattcgtctccacctcacggcatcgcagccctttgtaccggccattgtagcatgtgtgaagccctggaccataaggggcatgatgacttgacgtcatcccacctcctcc

SEQ ID NO: 1700 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaagaggttttgtagattagctccttgtcaccaagtggcagctctttgtcctctccattgtagcacgtgtgtagccctgggcataaaggccatgatgaccttgacatcatccccctcctcctca

SEQ ID NO: 1701 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacgccgtcgtagctgatacggcattactagcgattccggcttcatggaggcgagttgcagcctccaatccgaactgagctcagttttactggattcctccacctcgcggtctcggatcgttctgtactgagcattgtagtacgtgtgcagcccaggccgtaagggccatactgacttgacgtcgtcccaccttcctccctt

SEQ ID NO: 1702 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagcaggtttttgggattggcttcatatcactatgttgcagccctttgtcctgcccattgtagcacgtgtgtagccctgggcataaaggccatgatgacttgacatcatcccttcctcacgcct

SEQ ID NO: 1703 - DNA, 220 bp, Unknown
  Description of Unknown: 16S RNA Operational Taxonomic Unit polynucleotide
  Phylum: Acidobacteria; Family: Koribacteraceae
aaggcccggaacgtatcgaccgcggcgttctgatccgcgattactagcgattccagcttcatggagtcgagttgcagactccaatccgaactgaggccggctttttccgattagctccccctcacgggtttgcgacggtttgtaccgaccattgtagcacgtgtgtagccctggacataaaggccatgaggacttgacgtcatccccaccttcctcctcg

SEQ ID NO: 1704 - DNA, 220 bp, Unknown
  Description of Unknown: 16S RNA Operational Taxonomic Unit polynucleotide
  Phylum: Actinobacteria; Class: Actinobacteria; Order: Solirubrobacterales; Family: Solirubrobacteraceae
aaggcccgggaacgtattcaccgtggcagtgctgatccacgattactagcaactccaccttcatgcaggggtttcagcctgcaatccgaaccgagacgcgctttaagggattcgctccacctcgcggtatcgcagccctctgtacgcgccaatgtagcacgtgtgtagccctggacataaggggcatgatgacttgacgtcatccccaccttcctccggt

SEQ ID NO: 1705 - DNA, 220 bp, Unknown
  Description of Unknown: 16S RNA Operational Taxonomic Unit polynucleotide
  Phylum: Acidobacteria; Class: Chloracidobacteria
aaggcccgggaacgtattcaccgcggcgttctgatccgcgattactagcgattccaacttcatgaagtcgagttgcagacttcaatccgaactgagaccggtttttgcgattagctccctcttgcgagattgcgacgttttgtaccggccattgtagcacgtgtgtagccctgaacataaaggccatgatgacttgacatcatccccaccttctccgttt

SEQ ID NO: 1706 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Cystobacteraceae
aaggcccgggaacgtattcaccgcagcgtgctgatctgcgattactagcgattccgccttcatggagtcgagttgcagactccaatctgaactgagaccggttttatgccgatttggctccctctcgcgagttggcagcgctttgtaccggccattgtagcacgtgtgtagccctggtcataaaggccatgaggacttgacgtcatccccacttcctccg

SEQ ID NO: 1707 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccgtcgagttgcagacgacaatccgaactgaggcggggttaacggaattggcttgccgttgccggctcgcagccctctgtccctgccattgtagcacgtgtgtagccctagacgtaaggaccatgaggacttgacgtcatccccaccttcctccg

SEQ ID NO: 1708 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccgtcgagttgcagacgacaatccgaactgaggaccggttttgggattgcctaggcattgctgcctcggaccctctgtccggcccattgtagcacgtgtgtagccctagacgtaaggaccatgatgacttgacgtcgtccccaccttcctccggt

SEQ ID NO: 1709 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggctttttgggattcgctctaccttgcggtttcgctgccctttgtaccggccattgtagcatgtgtgcagccctggacataaggggcatgatgacttgacgtgtccccacttcctccgag

SEQ ID NO: 1710 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgatgctgatccacgattactagcgattccagcttcatgccgtcgagttgcagacgacaatccgaactgaggatcggttttgggattgccttggcattgctgcctcggcccccacctgtccgacccacttgttagcacgtgtgtagccctagacgtaaggaccatgatgacttgacgtcgtccccacccttcct

SEQ ID NO: 1711 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
agggcccgggaacgtattcaccgcagcatgctgatctgcgattactagcaactccaacttcatggggtcgagttgcagaccccaatccgaactgagaccggctttttgggattcgctccgcctcgcggcatcgcagccctttgtaccggccattgtagcacgtgtgcagcccaagacataaggggcatgatgatttgacgtcgtccccaccttcctccga

SEQ ID NO: 1712 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcacgcaggcgagttgcagcctacgatccgaactgagaccgacttctccgatagctccaccttgcggtatcgcgacggttgtatcggccattgtagcacgtgtgtagccccagacataaaggccatgctgacttgacgtcatccccaccttcctccggttt

SEQ ID NO: 1713 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcatgccggcgagttgcagccgacaatccgaactgagacaggcttttctccgatagctccaccttgcggtctcgcgacggtttgtacctgccattgtagcacgtgtgtggccccagacataaaggccatgctgacttgacgtcatccccaccttcctccgg

SEQ ID NO: 1714 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
gagacccgggaacgtattcaccgcgacatgctgatccgcgattactagcgattccaacttcatgtagtcgagttgcagactacaatccggactacgatacactttctgggattagctccccctcgcgggttggcggccctctgtatgtaccattgtatgacgtgtgaagccctacccataagggccatgaggacttgacgtcatccccaccttctccggt

SEQ ID NO: 1715 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aggacccgggaacgtattcaccgcgacattctgatccgcgattactagcgattccgacttcacgcagtcgagttgcagactgcgatccggactacgaccggttttctgggattggctccagctcgcgctttggcagccctctgtaccggccattgtatgacgtgtgtagccctaccataagggccatgaggacctgacgtcatccccaccttcctccggt

SEQ ID NO: 1716 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobia subdivision 3
aaggcctgggaacgtattcacggcgccgtagctgatgcgccattactagcgattccagcttcatgccgtcgagttgcagacgacaatctgaactggcccggtttttgggatttgctccatcttacgatcttgcttccctttgtgccgggcattgtagtacgtgtgcagccctggccgtaagggccatactgacttgacgtcatcccccaccttcctcctc

SEQ ID NO: 1717 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
acaaggcccgggaacgtattcaccgcgccatgctgatgcgcgattactagcgattccgacttcatgaggtcgagttgcagacctcaatctgaactgagacggcttttgcgattagctccctattgctaggtggctgcgcattgtcaccgccattgtagcacgtgtgtagcccagcccgtaagggccatgatgacttgacgtcatccccaccttcctccgg

SEQ ID NO: 1718 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgctctcgagttgcagagaacaatccgaactgagacgggcttttggtagattagctcaccctcgcgggtttgcagccctctgtcaccgccattgtagcacgtgtgtagcccagcgcgtaagggccatgaggacttgacgtcatccccaccttcctccg

SEQ ID NO: 1719 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcaagcaggcgagttgcagcctgctatccgaactgagacagactttctccgattagctcaccttgcgtctcgcgacggtttgtatctgccattgtagcacgtgtgtagccccagacataaggccatgctgacttgacgtcatccccacttcctccggttta

SEQ ID NO: 1720 - DNA, 220 bp, Unknown
  Description of Unknown: 16S RNA Operational Taxonomic Unit polynucleotide
  Phylum: Proteobacteria; Class: Betaproteobacteria; Order: Nitrosomonadales; Family: Nitrosomonadaceae
gagacccgggaacgtattcaccgcgacatgctgatccgcgattactagcgattccgacttcacggagtcgagttgcagactccgatccggactacgacgcgctttctgagattagctcccctcgcgggttggcaaccctctgtacgcgccattgtattacgtgtgaagccctacccataagggccatgaggacttgacgtcatccccaccttcctccggt

SEQ ID NO: 1721 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatgcaggcgagttgcagcctgcaatctgaactgagagaggtttttgagattagcgcctgtcaccaggtggcagctctttgtccttccattgtagcacgtgtgtagccctgggcataaaggccatgatgacttgacatcatcccctcttcctcgcgtct

SEQ ID NO: 1722 - DNA, 220 bp, Unknown
  Description of Unknown: 16S RNA Operational Taxonomic Unit polynucleotide
  Phylum: Proteobacteria; Class: Deltaproteobacteria; Order: Syntrophobacterales; Family: Syntrophobacteraceae
aaggcccgggaacgtattcaccgcggcgttctgatccgcgattactagcgattccagcttcatggagtcgagttgcagactccaatccgaactgagagcggctttttgggattggctcccctcgcgggttagcgaccctttgtaccgcccattgtagcacgtgtgtggccctggacataagggccatgatgacttgacgtcgtcccaccttcctccggct

SEQ ID NO: 1723 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcatgcaggcgagttgcagcctgcaatccgaactgagaccgactttctccgattagctccaccttgcggcatcgcgacggtttgtatcgcccattgtagcacgtgtgtagccctggatataaaggccatgctgacttgacgtcatccccaccttcctccgg

SEQ ID NO: 1724 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggccggaacgtagttcaccgtggcgctgctgatccacgattactagcaattccggcttcatgtagtcgagttgcagactacaatccgaactgaggaccgctttctgggattggcaccacctcgcggcttcgcaaccctttgtacggtccattgtagcacgtgtgtagccctagacgtaagggccatgatgacttgacgtcgtccccaccttcctccgg

SEQ ID NO: 1725 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagtagggcgttttttgggattagcttcacatcactgtgtttgcagccctttgtacgccccattgtagcacgtgtgtagccctgggcataaaggccatgatgacttgacatcatcccctccttcct

SEQ ID NO: 1726 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcgttgctgatatacgattactagcgattccagcttcatgcaggcgagttgcagcctgcaatctgaactgagagaggttttttgagattagcatcctgtcaccaggtagcagccctttgtacccccattgtagcacgtgtgtagccctgggcataaaggccatgatgacttgacatcatcccctccttctcacgt

SEQ ID NO: 1727 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcggcatagctgatccgcgattactagcgattccgacttcatggagtcgagttgcagactccaatccggactgggatcggctttctgggattggctccacctcgcggtcttgcaaccctctgtaccgaccattgtagtacgtgtgtagccctggccgtaagggccatgatgacttgacgtcatccccacttcctccgg

SEQ ID NO: 1728 - DNA, 220 bp, Unknown
  Description of Unknown: 16S RNA Operational Taxonomic Unit polynucleotide
  Phylum: Cyanobacteria; Class: Synechococcophycideae; Order: Pseudanabaenales; Family: Pseudanabaenaceae
agggcccgggaacgtattcaccgcagtatgctgacctgcgattactagcgattccgccttcatgcaggcgagttgcagcctgcaatctgaactgagccacggtttatgggattagcgcaccatcgctggctggcaaccctttgtccgtagcattgtagtacgtgtgtagcccaggacgtatggggcatgctgacttgacgtcatccacaccttcctccgg

SEQ ID NO: 1729 - DNA, 220 bp, Unknown
  Description of Unknown: 16S RNA Operational Taxonomic Unit polynucleotide
  Phylum: Chloroflexi; Class: SOGA31
aaggcccgggaacatattcaccgccgtatgctgaccggcggttactagcaactccggcttcatgcaggcgagttgcagcctgcaatccgaactgagaccggctttaagggattcgctccacctcgcggtttcgccgcccgttgtaccggccattgtagcgtgggtgtagcccaggcgtaaggggccatgctgacttgacgtcatccccaccttcctccga

SEQ ID NO: 1730 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagaaggttttgggattggctccttatcgctaagtggcagccctttgtccttcccattgtagcacgtgtgtagccctgggcataaaggccatgatgacttgacatcatcccctccttctcgcgt

SEQ ID NO: 1731 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccggacgtatcaccgtatcattgctgatatacgattactagcgattccagcttcatggagtcgagttgcagactccaatctgaactgagaggcgtttttgggattagcttcatatcactatgttgcagccctttgtacgccccattgtagcacgtgtgtagccctgggcataaaggccatgatgacttgacatcatcccctcttcctcacgtctt

SEQ ID NO: 1732 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccggaacgtattcccgtggcatgctgatccacgattactagcgattccaacttcatgggctcgagttgcagagcccaatccgaactgagacggctttttgagatttgctggggcttgcgcctttgcatcccattgtcaccgccattgtagcacgtgtgtagcccagcccgtaagggccatgaggacttgacgtcatccccacttcctcgcggctt

SEQ ID NO: 1733 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Saprospiraceae
aaggtccgggaacgtattcaccgcgccatggctgatgcgcgattactagcgattccaacttcatggagtcgggtttcagactccaatccgaactgagaccggctttacgggattggctccaccttgcggtttggcaaccctctgtaccggccattgtagcacgtgtgtcgccctgggcataagccatgatgacttgacgtcgtccccacttcctctcggc

SEQ ID NO: 1734 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcgtcgatctgatacgccattactagcgattccagcttcatgcagtcgagttgcagactgcaatccgaactgagcagagttttatccattagctccccctcgcgggttggcaacggtttgtaccctgcattgtaacacgtgtgtagccctgggacataaaggccatgcggacttgacgtcatccccaccttcctctcc

SEQ ID NO: 1735 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactacgatccggactacgaccggttttctgggattagctcccctcgcgggttggcaaccctctgtaccggccattgtatgacgtgtgaagccctacccataagggccatgaggacttgacgtcatccccaccttcctccggt

SEQ ID NO: 1736 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagcgtttttgggattggctccttatcgctaagtggcagccctttgtacgcccattgtagcacgtgtgtagccctgggcataaaggccatgatgacttgacatccatcccctcttcctcgcgtc

SEQ ID NO: 1737 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgcggcattgctgatccgcgattactagcgattccagcttcatgccgtcgagttgcagacgacaatccgaactgaggcgggtttacgggattggcttgccgttgccggctcgcggccctctgtccccgccattgtagcacgtgtgtagccctagacgtaaggaccatgatgacttgacgtcatccccacttcctccggt

SEQ ID NO: 1738 - DNA, 220 bp, Unknown
  Description of Unknown: 16S RNA Operational Taxonomic Unit polynucleotide
  Phylum: Proteobacteria; Class: Betaproteobacteria; Order: Methylophilales; Family: Methylophilaceae
aagacccgggaacgtattcaccgcgacattctgatccgcgattactagcgattccgacttcatgtagtcgagttgcagactacaatccggactacgatcggctttctgggattggctcccctcgcgggttggcaaccctctgtaccgaccattgtattacgtgtgaagccctggccataagggccatgaggacttgacgtcatccccaccttcctccggg

SEQ ID NO: 1739 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggcccgggaacgtattcaccgctgcctgctgatcagcgattactagcgattccgacttcaaagagtcgagttgcagactcttatctgtactgaggtcggttttttgcgattggctccccctcgcgggtttgcagcgctttgtaccgaccattgtagcacgtgtgtagccctggacataagggccatgatgacttgacgtcatccccaccttcctccgg

SEQ ID NO: 1740 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nakamurellaceae
aaggcccgggaacgtattcaccgcagcgttgctgatctgcgattactagcgactccgacttcatggggtcgagttgcagaccccaatccgaactgagaccggctttttgggtattcgctccacctcacggtttcgcagccctttgtaccggccatttgtagcatgcgtgaagcccaagacataaggggcatgatgatttgacgtcatccccacctttcct

SEQ ID NO: 1741 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatgcaggcgagttgcagcctgcaatctgaactgagataacttttttggattagctccttatcactaagtggcagccctttgtagttaccattgtagcacgtgtgtagccctgggcataaaggccatgatgacttgacatcatccctccttcctcacgc

SEQ ID NO: 1742 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggcccggaacgtattcaccgcggcatgctgatccgcgattactagcgattccgacttcatgcactcgagttgcagagtgcaatctgaactgagacggtttggggattagcatcacatcgctgtgtcgctgcccactgtcaccgccattgtagcacgtgtgtagcccagcccgtaagggccatgatgacttgacgtcatccccaccttcctccggctta

SEQ ID NO: 1743 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcagcaatgctgatctgcgattactagcgattccgacttcatggagtcgagttgcagactccaatccggactacgattagatttttctgggattggctcccgctcgcgcgttggcttccctctgtatctaccattgtagcacgtgtgtagccctggtcataaaggccatgatgacttgacgtcatccccaccttcctc

SEQ ID NO: 1744 - DNA, 220 bp, Unknown
  Description of Unknown: 16S RNA Operational Taxonomic Unit polynucleotide
  Phylum: Nitrospirae; Class: Nitrospira; Order: Nitrospirales; Family: Nitrospiraceae
aaggcccgggaacgtattcaccccggcgtgctgatccgggattactagcgattccgccttcacgaggtcgagttgcagacctcgatctgaactgaggtccggttttttgcgattggcctcccccttacgggtttgcagcgctttgtgccggccattgtagcacgtgtgtagccctaggcataaaggccatgctgacttgacgtcatccccaccttcctcc

SEQ ID NO: 1745 - DNA, 220 bp, Unknown
  Description of Unknown: 16S RNA Operational Taxonomic Unit polynucleotide
  Phylum: Chloroflexi; Class: SOGA31
aaggcccgggaacatattcaccgccgtatgctgaccggcggttactagcaactccggcttcatgtaggcgagttgcagcctacaatccgaactgagaccggctttcagggattcgctccacctcgcggtttcgcagcccgttgtaccggccattgtagcgtgggtgtagcccaggacgtaagggccatgctgacttgacgtcatccccacttccccgagt

SEQ ID NO: 1746 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggacacgaccggtttcttgggattagctccccctcgcggttggcagccctctgtaccggccattgtatgacgtgtgtagccctacccataagggccatgaggacctgacgtcatccccacttcctccggttg

SEQ ID NO: 1747 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccggacgtattcaccgcggcgtgctgatccgcgattactagcgattccaacttcatgcaggcgagttgcagcctacaatccgaactgagaccagctttatccgattagctcacctcgcgagtttgcaacggtttgtaccggccattgtagcacgtgtgtggccccagacataaaggccatgctgacttgacgtcatccccaccttcctccggttt

SEQ ID NO: 1748 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgcgaagggtcgcccttagcatccaattgtcaccgccattgtagcacgtgtgtagcccagccgtaacgggccatgaggacttgacgtcatccccaccttcctcgcggc

SEQ ID NO: 1749 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggaacgtattcaccgcggcatgctgatccgcgattactagcgattccgacttcatgctctcgagttgcagagagcaatccgaactgagacggttttcgagattggctcgggctcgcaccctcgctcccctctgtcaccgccattgtagcacgtgtgtagcccagcccataagggccatgaggacttgacgtcatccccgcccttccctggcc

SEQ ID NO: 1750 - DNA, 220 bp, Unknown
  Description of Unknown: 16S RNA Operational Taxonomic Unit polynucleotide
  Phylum: Acidobacteria; Class: Chloracidobacteria
acaagacccgggaacgtattcaccgcagcattctgatctgcgattactagcgattccaacttcatgaagtcgagttgcagacttcaatccgaactgagaccggttttgcgattagctccctcttacgagattgcgacgttttgtaccggccattgtagcacgtgtgtagccctaagcataaaggccatgatgacttgacatcatccccaccttcctccgt

SEQ ID NO: 1751 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgcagtcgagttgcagaccgcaatctgaactgagaagaggtttttgggattagctccttgtcgccaagtggcagccctttgtcctccccattgcagcacgtgtgtagccccgggcataaaggccatgatgacttgacatcatcccatccttcctcac

SEQ ID NO: 1752 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacggcgccgtagctgatgcgccattactagcgattccggcttcatggaggcgagttgcagcctccaatccgaactgagcccagttttactagattcctccacctcgcggtctcggatcgttctgtactgagcattgtagtacgtgtgcagccctggccgtaagggccatactgacttgacgtcgtccccacttcctccccg

SEQ ID NO: 1753 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgctctcgagttgcagagaacaatccgaactgagacggctttttgggagttgtctcactctcgcgagtttgtctgcccattgtcaccgccattgtagcacgtgtgtagcccagcgtgtaagggccatgaggacttgacgtcatccccaccttcctccg

SEQ ID NO: 1754 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardiaceae
gaggcccgggaacgtattcaccgcagcgttgctgatctgcgattactagcgactccgacttcacggggtcgagttgcagaccccgatccgaactgagaccagctttaagggattcgctccacctcacggtctcgcagccctctgtactggccattgtagcatgtgtgaagccctggacataaggggcatgatgacttgacgtcgtccccacttcctccga

SEQ ID NO: 1755 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcggcaatgctgatccgcgattactagcgattccgacttcacggagtcgagttgcagactccgatccggactaggatggggtttctgggattggctccggctcgcgccttggcgaccctctgtccccaccattgtagtacgtgtgtagccctcggccgtaagggccgactgatgacttgacgtcatccccacccttcc

SEQ ID NO: 1756 - DNA, 220 bp, Unknown
  Description of Unknown: 16S RNA Operational Taxonomic Unit polynucleotide
  Phylum: Proteobacteria; Class: Betaproteobacteria
acaagacccgggaacgtattcaccgcggcatgctgatccgcgattactagcgattccgacttcatgcagtcgagttgcagactgcaatccggactacgaccggctttctgggattggctcccctcgcgggttggctaccctctgtaccggccattgtatgacgtgtgaagccctacccataagggccatgaggacttgacgtcatccccaccttcctccg

SEQ ID NO: 1757 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
acaaggcccgggaacgaattcaccgcggcatgctgatccgcgattactagcaattccggcttcatgcaggcgagttgcagcctgcaatccgaactacgaacggctttctgggattggctccacctcgcggcttcgcaaccctttgtaccgcccattgtagcacgtgtgtagcccaggacataaggggcatgatgatttgacgtcatccccgccttcctcc

SEQ ID NO: 1758 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcagcgtgctgatctgccattactagcgattccagcttcatgcaggcgagttgcagcctgcaatccgaactgagaccggtttttccgattggctccccctcgcgggtttgctgcggtttgtaccggccattgtagcacgtgtgtagccctggacataaaggccatgaggacttgacgtcatccccacttcctccagct

SEQ ID NO: 1759 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Intrasporangiaceae
aaggcccgggaacgtattcaccgcagcgttgctgatctgcgattactagcgactccgacttcatggggtcgagttgcagaccccaatccgaactgagaccggtttttgggatcgctccacctcgcggtatcgcagccctttgtaccggccattgtagcatgcgtgaagcccaagacataaggggcatgatgatttgacgtcatccccaccttctccgagt

SEQ ID NO: 1760 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcacgcagtcgagttgcagactgcgatccggactacgatgcactttctgggattagctccccctcgcgggttggtcggccctctgtatgcaccattgtatgacgtgtgaagccctaccccataagggccatgaggacttgacgtcatccccacccttcctc

SEQ ID NO: 1761 - DNA, 220 bp, Unknown
  Description of Unknown: 16S RNA Operational Taxonomic Unit polynucleotide
  Phylum: Acidobacteria; Class: iii1-8; Order: DS-18
aaggcccgggaacgtattcaccgcggcgttctgatccgcgattactagcgattccagcttcatgcagtcgagttgcagactgcaatccgaactgagaacggctttgggattagctccacctcgcggctttgcgaccctttgtaccgtccattgtagcacgtgtgtagccctggacataaaggccatgaggacttgacgtcatccccacttcctccggttt

SEQ ID NO: 1762 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctggaacgtattcacggcgccgtagctgatgcgccattactagcgattccagcttcatgccgtcgagttgcagacgacaatctgaactgggcccggtttttagggatttgctccactttacagtcttgcttccctctgtgccgggcattgtagtacgtgtgcagccctggccgtaagggccatactgacttgacgtcatcccccaccttcctcct

SEQ ID NO: 1763 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggcccggaacgtattcggaccgcggcatgctgatccgcgattactagcgattccaacttcatgcactcgagttgcagagtgcaatccgaactgagatggcttttggagattagctcggcctcgcggcctcgctgcccactgtcaccaccattgtagcacgtgtgtagcccagcccgtaagggccatgaggacttgacgtcatccccaccttcctctcg

SEQ ID NO: 1764 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagaccttcaatctgaactgagtagacgttttttgagattgggcttcacatcactgtgttgctgctctttgtacgcccattgtagcacgtgtgtagccctgggcataaaggccatgatgacttgacatcatcccccttcctcac

SEQ ID NO: 1765 - DNA, 220 bp, Unknown
  Description of Unknown: 16S RNA Operational Taxonomic Unit polynucleotide
  Phylum: Acidobacteria; Class: Chloracidobacteria
aagacctgggaacgtattcaccgcagcgttctgatctgcgattactagcgattccaacttcatgaagtcgagttgcagacttcaatccgaactgagattggctttaaatgattagctcactcttacgagattgcgacattttgtaccaaccattgtagcacgtgtgtagccctgaacataaaggccatgatgacttgacatcatccccaccttcctccgt

SEQ ID NO: 1766 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcatgctgatccgcgattactagcgattccaacttcatgcaggcgagttgcagcctgcaatccgaactgagaccgactttgtccgattagctccaccttgcggtctcgcgacggtttgtgtcggccattgtagcacgtgtgtagccccaagcataaaggccatgctgacttgacgtcatccccaccttcctccgt

SEQ ID NO: 1767 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgctctcgagttgcagagaacaatccgaactgagacggcttttggagattagctcaccctcgcgggatgctgccccactgtcaccgccattgtagcacgtgtgtagcccagcgcgtaagggccatgagggacttgacgtcatccccaccttcctccgg

SEQ ID NO: 1768 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgcgccattgctgatgcgcgattactagcgattccagcttcatgtagtcgagttgcagactacaatctgaactgagaggaaggtttttgagatttgcatcctgtcaccaggtagcgtccctttgtcctcccattgtagcacgtgtgtagccctgggcataaaggccatgatgacttgacatcatcccctccttcctcac

SEQ ID NO: 1769 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
gaggcccgggaacgtattcacggtatcgttctgatataccattactagcgattccagcttcatgcaggcgagttgcagcctgcaatccgaactgagaacggttttttccgattagctccctctcgcgagttcgcagcggtttgtaccgtccattgtagcacgtgtgtagccctggacataaaggccatgatgacttgacgtcatcccccttcctccagct

SEQ ID NO: 1770 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcgttgctgatatacgattactagcgattccagcttcatgcagtcgagttgcagactgcaatctgaactgagataacttttttgggattagctccttatcactaagtggcagccctttgtagttaccattgtagcacgtgtgtagccctgggcataaaggccatgatgacttgacatcatcccctccttcctcag

SEQ ID NO: 1771 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagtaccagttttttgggattccgctccacctcacggtttcgcagccctttgtactggccattgtagcatgcgtgaagcccaagacataaggggcatgatgatttgacgtcatccccacttcctcc

SEQ ID NO: 1772 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgtctagggacttgcgtcttcgcttcccattgtcaccgccattgtagcacgtgtgtagcccagcccgtaagggccatgaggacttgacgtcatccccacttctcgcgg

SEQ ID NO: 1773 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcaagctgatccgcgattactagcgattccgacttcacgcagtcgagttgcagactgcaatccggactacgaccggcttttatggggattggctccagctcgcgctttggcaaccctctgtaccggccattgtatgacgtgtgaagccctaccataagggccatgaggcttgacgtcatccccacttcctccggt

SEQ ID NO: 1774 - DNA, 220 bp, Unknown
  Description of Unknown: 16S RNA Operational Taxonomic Unit polynucleotide
  Phylum: Proteobacteria; Class: Betaproteobacteria
aagacccggaacgtattcgaccgcgacatgctgatccgcgattactagcgattccgacttcacgcagtcgagttgcagactgcgatccggactacgatcggctttctgggattggctcccctcgcgggttggctgccctctgtaccgaccattgtatgacgtgtgaagccctacccataagggccatgaggacttgacgtcatccccaccttcctccggt

SEQ ID NO: 1775 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgttttttgggattagcttcacgtcgccgtgttgcagccctttgtacgccccattgtagcacgtgtgtagccctggcataaaggcccatgatgacttgacatcatcccctccttcctcac

SEQ ID NO: 1776 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccggggaacgtattcaccgcggcatgctgatccgcgattactagcgattccaacttcatgcactcgagttgcagagtgcaatccgaactgagacgacttttagggattggctcccctcgcgggattgcagccctctgtagtcgccattgtagcacgtgtgtagcccaccttgtaagggccatgaggacttgacgtcatcccaccttcctccgagc

SEQ ID NO: 1777 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcctgggaacgtattcaccgcggcatgctgatccgcgattactagcgattccaacttcatgcaggcgagttgcagcctacaatccgaactgagacggactttatgcgattggctcaccctcgcgggtttgcagcgctttgtatccgccattgtagcacgtgtgtggccctggacataaaggccatgctgacttgacgtcatcccaccttcctccggt

SEQ ID NO: 1778 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccgtcgagttgcagacgacaatccgaactgaggcgggtttcggggattggctcgccgttgccggctcgcgaccctctgtcccgccattgtagcacgtgtgtagccctagacgtaaggaccatgatgacttgacgtcgtccccaccttcctccgcc

SEQ ID NO: 1779 - DNA, 220 bp, Unknown
  Description of Unknown: 16S RNA Operational Taxonomic Unit polynucleotide
  Phylum: Actinobacteria; Class: Actinobacteria; Order: MC47
acaaggcccgggaacgtattcaccgcggcaatgctgatccgcgattactagcaactccgccttcatgaaggcgagtttcagccttcaatccgaaccgggaccggctttttgggattcgctccccctcacgggtttgcagccctttgtaccggccaatgtagcacgtgtgtagccctggacataagggtcatgctgacttgacatcatccccaccttcctc

SEQ ID NO: 1780 - DNA, 220 bp, Unknown
  Description of Unknown: 16S RNA Operational Taxonomic Unit polynucleotide
  Phylum: Chloroflexi
aaggcccgggaacatattcaccgtagtgtgctgacccacggttactagcaactccgacttcaagcaggcgagttgcagcctgctatccgaactgagactggcttttttgagattgctccacctcgcggtcttgcttccctttgtaccagccattgtagcgtgtgtgtagccccagaacgtaagagccatgctgacttgacgtcatccccaccttcctccg

SEQ ID NO: 1781 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgagaccggctttgctgggattggctccacctcgcggcttcgcttcccgttgtaccggcattgtagtacgtgtgtagcccaggtcataagggcatgatgatttgacgtcatccccaccttcctccggt

SEQ ID NO: 1782 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcactgctgatctgcgattactagcaactccgacttcatggggtcgagttgcagaccccaatccgaactgagacaggctttttgagattcgctccgcctcacggcttcgcagctcattgtacctgccattgtagcaccgtgtgcagcccaagacataaggggcatgactgaccttgacgtcgtccccaccttcct

SEQ ID NO: 1783 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgctaggggttgccccttcgcgtccacttgtcaccgccattgtagcacgtgtgtagcccacgcccgtaagggccatgaggacttgacgtcatccccacccttcctcgc

SEQ ID NO: 1784 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaggtcgagttgcagacctcaattcgaactgagagaaggtttttgagattagcatcctgttaccaggtagcaaccctttgtccttcccattgtagcacgtgtgtagccctgggcataaaggccatgatgacttgacatcatcccctccttctcgcg

SEQ ID NO: 1785 - DNA, 220 bp, Unknown
  Description of Unknown: 16S RNA Operational Taxonomic Unit polynucleotide
  Phylum: Proteobacteria; Class: Betaproteobacteria
aagacccggaacgtattcaccgcgacatgctgatccgcgattactagcgattccgacttcacgcagtcgagttgcagactgcgatccggactacgaacggctttctgggatggctccacctcgcggcttggcaaccctctgtaccgtccattgtatgacgtgtgaagccctacccataagggccatgaggacttgacgtcatccccaccttcctccggtt

SEQ ID NO: 1786 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccgggaacgtattcaccgcagcgttgctgatctgcgattactagcgactccgacttcatggggtcgagttgcagaccccaatccgaactgagaccggctttttggattcgctccacattgctgtttcgcagccctttgtaccggccattgtagcatgcttgaagccctaggcataagggcatgagacttgacgtcatccccaccttctccgagtt

SEQ ID NO: 1787 - DNA, 220 bp, Unknown
  Description of Unknown: 16S RNA Operational Taxonomic Unit polynucleotide
  Phylum: Acidobacteria
aaaggcccgggaacgtattcaccgcggcgttctgatccgcgattactagcgattccagcttcatggagtcgagttgcagactccaatccgaactgaggtcggctttttccgattagctccccctcgcgggtttgcgacgttttgtaccgaccattgtagcacgtgtgtagccctggacataaaggccatgaggacttgacgtcatccccactcctccggt

SEQ ID NO: 1788 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagaaggtttttgggattcgctccttatcactaagtggcagccctttgtcctccccattgtagcacgtgtgtagccctgggcataaaggccatgatgacttgacatcattcccctccttcctcg

SEQ ID NO: 1789 - DNA, 220 bp, Unknown
  Description of Unknown: 16S RNA Operational Taxonomic Unit polynucleotide
  Phylum: Chloroflexi; Class: SOGA31
aaggcccgggaacatattcaccgccgtatgctgaccggcggttactagcaactccggcttcatgcaggcgagttgcagcctacaatccgaactgagaccggctttaagggattagctccacctcgcggtttgcaggcccgttgtaccggccattgtagcgtgggtgtagcccaggacgtaagggccatgctgacttgacgtcatccccacttcctccgag

SEQ ID NO: 1790 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgctctcgagttgcagagaacaatccggactacgaccggctttctgggatttgctcccctcgcgggttggcagccctctgtaccggccattgtattacgtgtgaagccctacccataagggccatgaggacttgacgtcatccccacttcctccggtt

SEQ ID NO: 1791 - DNA, 220 bp, Unknown
  Description of Unknown: 16S RNA Operational Taxonomic Unit polynucleotide
  Phylum: Actinobacteria; Class: Actinobacteria; Order: MC47
aagccccgtgtacgtattcaccgcggcgttgctgatccgcgattactagcaactccgccttcatgaaggcgagtttcagccttcaatccgaaccgggaccggctttttgggattcgctcactctcacaagtttgcagcccctttgtaccggccaatgtagcacgtgtgtagcccaggacataaggggcatgatgacttgacatcatccccaccttcctcc

SEQ ID NO: 1792 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagattgccaggacttgcgtcttcgcatcccattgtcaccgccattgtagcacgtgtgtagcccagcccgtaagggccatgaggacttgacgtcatccccaccttcctcgggtt

SEQ ID NO: 1793 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
acaaggcccgggaacgtattcaccgcagcgtgctgatctgcgattactagcaattccaacttcatgcactcgagttgcagagtgcaatccgaactgagacggcttttagggattagcatgtcctcgcggactagctgccctctgtcaccgccattgtagcacgtgtgtagcccagcccgtaagggccatgaagacttgacgtcatccccaccttcctccg

SEQ ID NO: 1794 - DNA, 220 bp, Unknown
  Description of Unknown: 16S RNA Operational Taxonomic Unit polynucleotide
  Phylum: Actinobacteria; Class: Actinobacteria; Order: MC47
aagacccggaacatattcaccgcggcgttgctgatccgcgattactagcaactccaccttcatggaggcgagtttcagcctccaatccgaaccgagaccgctttttgggattcgctcaccctcgcaggtttgcagccctttgtaccggccaatgtagcacgtttgtagcccaagacataaggggcatgatgacttgacgtcatccccacttcctccgatt

SEQ ID NO: 1795 - DNA, 220 bp, Unknown
  Description of Unknown: 16S RNA Operational Taxonomic Unit polynucleotide
  Phylum: Proteobacteria; Class: Betaproteobacteria
aagaccccgggaacgtattcaccgcgacatgctgatccgcgattactagcgattccgacttcatgcagtcgagttgcagactgcaatccggactacgaccggctttatggggattggctccgcctcgcggcttggcaaccctctgtaccggccattgtatgacgtgtgaagccctacccataagggccatgaggacttgacgtcatccccaccttcctcc

SEQ ID NO: 1796 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcagcaatgctgatctgcgattactagcgattccgacttcatggagtcgagttgcagactccaatccggactacgacaggttttctgggattagctccctctcgcgagtttggcttcccctctgtacctgccattgtagcacgtgtgtagccctggtcataaaggccatgatgacttgacgtcatccccaccttcctc

SEQ ID NO: 1797 - DNA, 220 bp, Unknown
  Description of Unknown: 16S RNA Operational Taxonomic Unit polynucleotide
  Phylum: Acidobacteria; Class: Chloracidobacteria
aagaccggaacgtattcaccgcagcatgctgatctgcgattactagcgattccaacttcatgcagtcgagttgcagactgcaatccgaactgagaccggtttttccgattggctccgtctcgcgacttcgcgacggtttgtaccggccattgtagcacgtgtgtagccctggacataaaggccatgaggacttgacgtcatccccaccttctccggttta

SEQ ID NO: 1798 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgtgctgatctgcgattactagcgattccagcttcatggagtcgagttgcagactccaatccgaactgaggatgactttttccgattagctcccctcgcgggtttgcgacgtttgtatcacccattgtagcacgtgtgtagccctggacataaaggccatgaggacttgacgtcatccccaccttcctcccgtt

SEQ ID NO: 1799 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggccggaacgtattcaccgtggcattctgatccacgattactagcgattccaacttcatgcactcgagttgcagagtgcaatccgaactgagacggcttttggagattagctcaccctcgcgggttagctgcccattgtcaccgccattgtagcacgtgtgtagcccagcccgtaagggccatgaggacttgacgtcatccccaccttcctctcggct

SEQ ID NO: 1800 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgcgccattgctgatgcgcgattactagcgattccagcttcacggagtcgagttgcagactccgatctgaactgagagggagttttgagattagcatcctgtcaccaggtagcgaccctttgtctcccccattgtagcacgtgtgtagccctgggcataaaggccatgatgacctgacatcatcccctccttcctcgcg

SEQ ID NO: 1801 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatggagtcgagttgcagactccaatccggactacgacgcgctttgcgggattggctccagatcgctccttggcaaccctctgtacgcgccattgtattacgtgtgaagccctaccataagggccatgaggacttgacgtcatcccccttcctccggtct

SEQ ID NO: 1802 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggacgtattcaccgtatcattgctgatatacgattactagcgattccagcttcatggagtcgagttgcagactccaatctgaactgagaagaggttttgggattagctccttatcactaagtggcagccctttgtcctctccattgtagcacgtgtgtagccctgggcataaggccatgatgacttgacatcatcccctccttcctcacgtc

SEQ ID NO: 1803 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcgacatgctgatccgcgattactagcgattccaacttcatgcagtcgagttgcagactgcgatccggactacgaccggttttctgggattggctccccctcgcgggttggcagccctctgtaccggccattgtatgacgtgtgtagccctacccataagggccatgaggacctgacgtcatccccaccttcctccgt

SEQ ID NO: 1804 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
acaaggcccgggaacgtattcaccgcggcgtgctgatccgcgattactagcgattccaacttcacgcacccgagttgcagagtgcgatccgaactgagatggcttttggagattggctcgatctcgcgatctcgctgcccactgtcaccaccattgtagcacgtgtgtagcccagcccataagggccatgaggacttgacgtcatccccgcttctccggc

SEQ ID NO: 1805 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Brucellaceae
aaggcccgggaacgtattcaccgcggcatgctgatccgcgattactagcgattccaacttcatgcactcgagttgcagagtgcaatccgaactgagatggcttttggagattagctcacactcgcgtgctcgctgcccactgtcaccaccattgtagcacgtgtgtagcccagcccgtaagggccatgaggacttgacgtcatccccacttcccggctat

SEQ ID NO: 1806 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagaaggtttttgggattggctccttatcgctaagtggcagccctttgtccttcccattgtagcacgtgtgtagccctggggcataaaaggccatgatgacttgacatcatcccctccttcctc

SEQ ID NO: 1807 - DNA, 220 bp, Unknown
  Description of Unknown: 16S RNA Operational Taxonomic Unit polynucleotide
  Phylum: Chloroflexi; Class: Bljii12; Order: AKYG885; Family: Dolo_23
agggcccgggaacgtattcaccgcagtgtgctgacctgcggttactagcaactccgcgttcatgcaggcgagttgcagcctgcaatcccaactgagaccggctttggtgcgattcgctccgggtcgccccatcgctgcgcgttgtaccggccattgtagcgtgtgtgtagccctggacgtaagagccgtgctgacttgacgtcatccccaccttcctccg

SEQ ID NO: 1808 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgcagtcgagttgcagactgcaatccggactacgacgcgctttttagggagttggctccacctcgcggcttggcaaccctctgtacgcgccattgtattacgtgtgaagccctacccataagggccatgaggacttgacgtcatcccccaccttcctc

SEQ ID NO: 1809 - DNA, 220 bp, Unknown
  Description of Unknown: 16S RNA Operational Taxonomic Unit polynucleotide
  Phylum: Armatimonadetes; Class: CH21
aagacccgggaacgtattcaacgcagtatagctgacctgcgtttactagcgattccgccttcatgcagtcgagttgcagactgcaatctgaactgggggcgtatttttgggattgctccacctcacggtattgctgccctttgttgcgcccattgtagcatgtgtgaagccccagacgtaactgccatgctgacttgacgtcatccccacttcctccgat

SEQ ID NO: 1810 - DNA, 220 bp, Unknown
  Description of Unknown: 16S RNA Operational Taxonomic Unit polynucleotide
  Phylum: Proteobacteria; Class: Betaproteobacteria
aagacccggaacggtattcaccgcgacatgctgatccgcgattactagcgattccgacttcatgcagtcgagttgcagactgcaatccggactacgaccggctttctggggagttggctccgcctcgcggcttggcaaccctctgtaccggccattgtatgacgtgtgaagccctacccataagggccatgaggacttgacgtcatccccaccttcctcc

SEQ ID NO: 1811 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcggcatgctgatccgcgattactagcgattccaacttcatgcagtcgagttgcagactgcaatccggactacgatacactttctgggattggctcccctcgcgggttggcaaccctctgtatgtaccattgtatgacgtgtgaagcctacccataagggccatgaggacttgacgtcatccccactcctccggttgt

SEQ ID NO: 1812 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacccggttttttgtcgattggctcccccttgcaggtttgcagcgctttgtaccggccattgtagcacgtgtgtagccctggacataaaggccatgaggacttgacgtcatccccaccttcctcc

SEQ ID NO: 1813 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagacccggaacgtattcaccgcgacattctgatccgcgattactagcgattccgacttcacgcagtcgagttgcagactgcgatccggactacgactggttttctgggattagctccccctcgcgggttggcaaccctctgtaccagccattgtatgacgtgtgtagccccacctataagggccatgaggacttgacgtcatccccaccttcctccggt

SEQ ID NO: 1814 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
aaggccggaacgtattcaccggatcatggctgatatccgattactagcgattccagcttcacggagtcgagttgcagactccgatccgaactgagaacggttttgtagattcgctcctggtcacccagtggctgctctctgtaccgtccattgtagcacgtgtgtagcccaaggcgtaagggccgtgatgatttgacgtcatcccccaccttcctcacag

SEQ ID NO: 1815 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtcccgggaacgtattcaccgtatcattgctgatatacgattactagcgattccagcttcatgaggtcgagttgcagacctcaatctgaactgagataggatttttgagattagcatcctgttaccaggtagcagccctttgttcctaccattgtagccacgtgtgtagccctgggcataaaggccatgatgacttgacatcatcccctccttcctc

SEQ ID NO: 1816 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggcccgggaacgtattcaccgcgtcattgctgatacgcgattactagcgattccagcttcacgaagtcgagttgcagacttcgatccgaactgaggagcggctttttgaagattgggcatcctgtcaccaggtagcaaccctttgtaccgcccattgtagcacgtgtgtagccctaggcgtaagggccatgatgacctgacgtcatccccacttcctc

SEQ ID NO: 1817 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacatattcaccgcggcattgctgatccgcgattactagcaactccgccttcatggaggcgagtttcagcctccaatccgaaccgagaccgactttttgggattcgctccctctcacgagtttgcagccctttgtatcggccaatgtagcacgtgtgtagcccaggacataaggggcatgatgacttgacttcgaccccacttcccggat

SEQ ID NO: 1818 - DNA, 220 bp, Unknown
  Description of Unknown: 16S RNA Operational Taxonomic Unit polynucleotide
  Phylum: Proteobacteria; Class: Alphaproteobacteria
aaggcccgggaacgtattcaccgcagcctgctgttctgcgattactagcgattccaccttcatgcacccgagttgcagagtgcaatctgaactgggacggtttttgggatcgcatccactcgcgtggtcgctgcccactgtcaccgccattgtagcacgtgtgtagcccaggccgtaagggccatgaggacttgacgtcatccccactcctccggcttgt

SEQ ID NO: 1819 - DNA, 220 bp, Unknown
  Description of Unknown: 16S RNA Operational Taxonomic Unit polynucleotide
  Phylum: Acidobacteria; Class: Acidobacteria-5
aaggcccgggaacgtattcaccactgcttgctgatcagtgattactagcgattccagcttcatggagtcgagttgcagactccaatccgaactgagaccggcttttgagattggctccccctcgcgggtttgcgactctttgtaccggccattgtagtacgtgtgtagccctggacataaaggccatgaggacttgacgtcatccccaccttcctccggg

SEQ ID NO: 1820 - DNA, 220 bp, Unknown
  Description of Unknown: 16S RNA Operational Taxonomic Unit polynucleotide
  Phylum: Proteobacteria; Class: Betaproteobacteria
aagacccgggaacggtattcaccgcgacatgctgatccgcgattactagcgattccgacttcatgcagtcgagttgcagactgcaatccggactacgacgcgctttaggggagttggctccagatcgctccttggcaaccctctgtacgcgccattgtattacgtgtgaagccctacccataagggccatgaggacttgacgtcatccccaccttcctcc

SEQ ID NO: 1821 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgcagtcgagttgcagactgcaatccggactacgatacactttctgggattacgctcccccgtcgcgggttggcagccctctgtatgtaccattgtatgacgtgtgaagccctacccataagggccatgaggacttgacgtcatccccaccttcctcc

SEQ ID NO: 1822 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Acetobacteraceae
acaaggcccgggaacgtattcaccgcggcgtgctgatccgcgattactagcgattccaccttcatgcacccgagttgcagagtgcaatctgaactgagacggcttttggggatcggctcggcctcgcgacctggcttcccactgtcaccgccattgtagcacgtgtgtagcccaggacataagggccatgaggacttgacgtcatccccacttcctccgg

SEQ ID NO: 1823 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Geodermatophilaceae
aaggccggaacgtattcaccgcagcgttgctgatctgcgattactagcgactccaacttcatggggtcgagttgcagaccccaatccgaactgagaccggctttttgggattcgctccacctcacggtatcgcagccctttgtaccggccattgtagcatgtttgcagccctagacataaggggcatgatgatttgacgtcatccccacttcctccgagt

SEQ ID NO: 1824 - DNA, 220 bp, Unknown
  Description of Unknown: 16S RNA Operational Taxonomic Unit polynucleotide
  Phylum: Chloroflexi; Class: Bljii12; Order: B07_WMSP1; Family: FFCH4570
aaggcccgggaacgtattcactgctgtgtgctgaccagcagttactagcaactccgacttcatgcaggcgagttgcagcctgcaatccgaactgagaccggctttggtgggatttgctccaggtcgcccttcgccgcccgttgtaccggccattgtagcgtgtgtgtagccctcggcgtaagagccgtgctgacttgacgtcatcccaccttcctccggt

SEQ ID NO: 1825 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcatgctgatccgcgattactagcgattccgacttcatgcagtcgagttgcagactgcaatccggactacgaacggcttttatggggattggctccccctcgcgggttggcaaccctctgtaccgtccattgtatgacgtgtgaagccctacccataagggccatgaggacttgacgtcatccccaccttcctcg

SEQ ID NO: 1826 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgctctcgagttgcagagaacaatccgaactgagacggcttttggagattaggctcaccctcgcgggtttgcagccctctgtcaccgccattgtagcacgtgtgtagcccagcgccgtaaggggccatgaggacttgacgtcatccccaccttcctcc

SEQ ID NO: 1827 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcgtcatagctgatacgcgattactagcgattccagcttcatagagtcgagttgcagactccaatccgaactgagaacggctttttgggattggcatcacctcgcagtgtagctaccctctgtaccgcccattgtagcacgtgtgttgccctggacgtaagggccatgatgacttgacgtcgtcccccttcctctcaa

SEQ ID NO: 1828 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcagcgtgctgatctgccattactagcgattccagcttcatgcaggcgagttgcagcctgcaatccgaactgagaacggtttttgcgattggctccccctcgcgggtttgctgcgctttgtaccgtccattgtagcacgtgtgtagccctggacataaaggccatgaggacttgacgtcactccccaccttcctccaa

SEQ ID NO: 1829 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aagacccggacgtattcaccgcgacaagctgatccgcgattactagcgattccgacttcacgcagtcgagttgcagactgcgatccggactgagagaggttttctgggattggctccacctcgcggctttgcgaccctctgtacctcccattgtagtacgtgtgtagccctggtcgtaagggccatgatgacttgacgtcatccccaccttcctccggtt

SEQ ID NO: 1830 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgtgctgatctgcgattactagcgattccagcttcatggagtcgagttgcagactccaatccgaactgaggatggcttttccgattgctccccctcgcgggtttgcgacggtttgtaccacccattgtagcacgtgtgtagccctggacataaaggccatgaggacttgacgtcatccccaccttcctccccgt

SEQ ID NO: 1831 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccggaacgtattcaccgcggcgtgctgatccgcgattactagcgattccaacttcatgcaggcgagttgcagcctgcaatccgaactgagacagactttctccgattagctccaccttgcggtctcgcgacggtttgtatctgccattgtagcacgtgtgtagccccagacataaaggccatgctgacttgacgtcatccccaccttctccggtt

SEQ ID NO: 1832 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggaacgtattcaccgaggcatgctgatcctcgattactagcgattccaacttcatgcactcgagttgcagagtgcaatccgaactgagacggctttttaggattcggctcggctcgcgccatcgcatcccattgtcaccgccattgtagcacgtgtgtagcccagcccgtaagggccatgaggacttgacgtcatccccaccttcctccggc

SEQ ID NO: 1833 - DNA, 220 bp, Unknown
  Description of Unknown: 16S RNA Operational Taxonomic Unit polynucleotide
  Phylum: Chloroflexi; Class: SOGA31
aaggcccgggaacgtattcaccgcagtgtgctgacctgcggttactagcaactccggcttcatgcaggcgagttgcagcctacaatccgaactgagaccggctttaagggattcgctccacctcgcggtttcgccgcccgttgtaccggccattgtagcgtgggtgtagcccaagacgtaagggccatgctgacttgacgtcatccccaccttcctccga

SEQ ID NO: 1834 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcacgcaggcgagttgcagcctacgatccgaactgagaccgactttctccgacttagcctccaccttgcggtatcgcgacggtttgtgtcggccattgtagcacgtgtgtggccccacgacataaaggccatgctgacttgacgtcatccccaccttcctc

SEQ ID NO: 1835 - DNA, 220 bp, Unknown
  Description of Unknown: 16S RNA Operational Taxonomic Unit polynucleotide
  Phylum: Acidobacteria; Class: Chloracidobacteria
aggacccgggaacgtattcaccgcgacgttctgattcgcgattactagcgattccaacttcatggagtcgagttgcagactccaatccgaactgagaccggtttttgcgattagctccctcttacgagatcgcgacgttttgtaccggccattgtagcacgtgtgtagccctgaacataaaggccatgatgacttgacatcatccccaccttcctccgtt

SEQ ID NO: 1836 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgtattcaccgcgacgttgctgattcgcgattactagcaactccgccttcatggaggcgagtttcagcctccaatccgaaccgggaccggctttttgggattcgctcactctcacgagtttgcagccctttgtaccggccaatgtagcacgtgtgtagcccaagacataaggggcatgatgacttgacgtcatccccaccttcctccg

SEQ ID NO: 1837 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcatgctgatccacgattactagcgattccaacttcatgggctcgagttgcagagcccaatccgaactgagacggctttttgagatttgcgaggggtcgcccctttggcatcccattgtcaccgccattgtagcacgtgtgtagcccagcccgtaagggccatgaggacttgacgtccatccccaccttcctcgc

SEQ ID NO: 1838 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgaatattcaccgcggcattgctgatccgcgattactagcaactccgccttcatggaggcgagtttcagcctccaatccgaaccgggaccggctttttgggattcgctcactctcgcgagtttgcagccctttgtaccggccaatgtagcacgtgtgtagcccaagacataaggggcatgatgacttgacgtcatccccaccttccct

SEQ ID NO: 1839 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacggcgccgtagctgatgcgccattactagcgattccggcttcatggagtcgagttgcagactccaatccgaactgggcccagttttactagattacctccacctcgcggtctcggatcgttctgtactgggcattgtagtacgtgtgcagccctggccgtaagggccatactgacttgacgtcggtctccccaccttcct

SEQ ID NO: 1840 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcggcatgctgatccgcgattactagcgattccaacttcacgtagtcgagttgcagactacgatccggactacgatacactttctgggatagctccccctcgcgggttggcggccctctgtatgtaccattgtatgacgtgtgaagccctaccccataaggggccatgaggacttgacgtcatccccaccttcctccg

SEQ ID NO: 1841 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggccccgggaacgtattcaccgtggcgtagctgatccacgattactagcgattccagcttcatgccgtcgagttgcagacgacaatccgaactgaggcggggtttacgggattggcttgccgttgccggctcgcggccctctgtccccgccattgtagcacgtgtgtagccctagacgtaaggaccatgatgacttgacgtcatccccaccttcctcc

SEQ ID NO: 1842 - DNA, 220 bp, Unknown
  Description of Unknown: 16S RNA Operational Taxonomic Unit polynucleotide
  Phylum: Cyanobacteria; Class: Oscillatoriophycideae
aaggccggaacgaatcgactgcagtatgctgacctgcaattactagcgattcctccttcacgcaggcgagttgcagcctgcgatctgaactgagccacggtttatgggattagcttgcgatcgctcgcttgctgccctttgtccgtcgcattgtagtacgtgtgtagcccaggacgtaaggggcatgctgacttgacgtcatccccacttcctccggttt

SEQ ID NO: 1843 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgtttttgggtagttagcttcatatcgctatgttgcagccctttgtacgcccccacttgtagcacgtgtgtagccctgggcataaaggccatgatgacttgacatcatcccctccttcct

SEQ ID NO: 1844 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
gagacccgggaacgtattcaccgcgacgttgctgattcgcgattactagcgattccgacttcacggagtcgagttgcagactccgatccggactacgactggctttctgggattggctccccctcgcgggttggcagccctttgtaccagccattgtagcacgtgtgtagccctggtcataagggccatgatgacttgacgtcatccccaccttcctccg

SEQ ID NO: 1845 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggctcgggaacgtattcaccgcagcaatgctgatctgcgattactagcgattccgacttcatggagtcgagttgcagactccaatccggactgagaaaaggtttctgggattggctcaccctcgcgggatcgcagccctctgtccttcccattgtagtacgtgtgtagccctggccgtaagggccatgatgacttgacgtcatccccaccttcctccg

SEQ ID NO: 1846 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcatgctgatccgcgattactagcgattccaacttcatgcaggcgagttgcagcctgcaatccgaactgagaccggctttctccgattggctcccctcgcgggattgcaacggtttgtaccggccattgtagcacgtgtgtagccccagacataaaggccatgctgacttgacgtcatccccaccttcctccggt

SEQ ID NO: 1847 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Polyangiaceae
aaggcccgggaacgtattcacccctgcctgctgatcagggattactagcgattccaacttcaaagagtcgagttgcagactcttatctgtactgaggtcagtttttccgattggctccccctcacggttcgcgacggttgtgctgaccattgtagcacgtgtgtagccctggacataagggccatgatgacttgacgtcatccccaccttcctccgattt

SEQ ID NO: 1848 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgtattcaccgcgacgttgctgattcgcgattactagcaactccgacttcatggaggcgagtttcagcctccaatccgaaccgggaccggctttttgggattcgctcccctcgcgggtttgcagccctttgtaccggccaatgtagcacgtgtgtagccctagacataagggtcatgctgacttgacgtcatccccaccttctccgat

SEQ ID NO: 1849 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgcagtcgagttgcagactgcaatccggactacgacgcgctttaagggattggctccaggtcgccccttggccaaccctcctgtacgcgccattgtattacgtgtgaagccctacccataagggccgatgaggacttgacgtcatccccaccttcctc

SEQ ID NO: 1850 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgttttgggagttggcgtccttatcgctaagtggcagccctttgtacgccccacttgtagcacgtgtgtagccctgggcataaaggccatgatgacttgacatcatcccctccttcctcg

SEQ ID NO: 1851 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
aaggccgggacgtattcaccggatcatggctgatatccgattactagcgattccagcttcacggagtcgagttgcagactccgatccgaactgtgaccggttttatagattcgctcctggtcgcccagtggctgctctctgtaccggccattgtagcacgtgtgtagcccaaggcgtaagggccgtgatgatttgacgtcatccccacttcctcacagtt

SEQ ID NO: 1852 - DNA, 220 bp, Unknown
  Description of Unknown: 16S RNA Operational Taxonomic Unit polynucleotide
  Phylum: TM7; Class: TM7-3; Order: EW055
gagacccggacgtattcaccgcaacttgctgatttgcgattactagcgattccgacttcatggaggcgagtttcagcctccaatccgaactgggactagctttggtgcgatttgctccacctcgcggcttcgctgcgcattgtactagccattgtatcgtgtttctagcccaggacgtaagggaaatactgacctgacatcatcccctccttcctccccg

SEQ ID NO: 1853 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgtgctgatctgcgattactagcgattccagcttcatggagtcgagttgcagactccaatccggatgggattggctttttccgattagctcccctcgcggtttgcgacggtttgtaccaaccattgtagcacgtgtgtagccctggacataaaggccatgaggacttgacgtcatccccaccttcctccccgta

SEQ ID NO: 1854 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcactgctgatctgcgattactagcgactccgacttcatggggtcgagttgcacgacccccaatccgaactgagaccggctttttgagattcgctccacctcgcggtatcgcagctcattgtaccggccattgtagcacgtgtgcagcccaagacataaggggcatgatgacttgacgtcgtccccaccttccta

SEQ ID NO: 1855 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcggcgttctgatccgccattactagcgattccagcttcatgcaggcgagttgcagcctgcaatccgaactgagaacggttttttgcgatttgctccccctcgcgggttggcggcgctttgtaccgtccattgtagcacgtgtgtagccctggacataaaggccatgatgacttgacgtcatccccaccttcctccaa

SEQ ID NO: 1856 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggctttttgggtattcgctccaccttgcggtatcgcagccctttgtaccggccattgtagcatgcttgaagccctggaccataaggggcaatgatgatttgacgtcatcccaccttcctc

SEQ ID NO: 1857 - DNA, 220 bp, Unknown
  Description of Unknown: 16S RNA Operational Taxonomic Unit polynucleotide
  Phylum: Firmicutes; Class: Bacilli; Order: Bacillales; Family: Sporolactobacillaceae
aaggcccgggaacgtattcaccgcggcatgctgatccgcgattactagcgattccggcttcatgcaggcgggttgcagcctgcaatccgaactgggaatggtttctgggattggcttaacctcgcggtctcgcagccctttgtaccatccattgtagcacgtgtgtagcccaggtcataaggggcatgatgatttgacgtcatccccaccttcctccggt

SEQ ID NO: 1858 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccggcttcatgtaggcgagttgcagcctacaatccgaactgagaatggctttatgagattagctagccctcgcgggtttgcgactctttgtaccatccattgtagcacgtgtgtagcccaggtcataaggggcatgatgatttgacgtcatccccactctccggtcg

SEQ ID NO: 1859 - DNA, 220 bp, Unknown
  Description of Unknown: 16S RNA Operational Taxonomic Unit polynucleotide
  Phylum: Chloroflexi; Class: SOGA31
aaggcccgggaacatattcaccgccgtatgctgaccggcggttactagcaactccggcttcatgtaggcgagttgcagcctacaatccgaactgagaccggcttttaagggatcgctccacctcgcggtttcgcagcccgttgtaccggccattgtagcgtgggtgtagccccaggacgtaagggccatgctgacttgacgtcatccccaccttctccga

SEQ ID NO: 1860 - DNA, 220 bp, Unknown
  Description of Unknown: 16S RNA Operational Taxonomic Unit polynucleotide
  Phylum: Actinobacteria; Class: Actinobacteria; Order: MC47
acaaggcccgggaacatattcaccgcggcgttgctgatccgcgattactagcaactccgccttcatggaggcgagtttcagcctccaatccgaaccgggaccggctttttgggattcgctcaccctcgcaggtttgcagccctttgtaccggccaatgtagcacgtttgtagcccaggacataaggggcatgatgacttgacctcatccccacttcctcc

SEQ ID NO: 1861 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggcccaggaacgtattcaccgcgtcattgctgatacgcgattactagcgattccagcttcacgaagtcgagttgcagacttcgatccgaactgagagcggcttttgagattggcatcctgtcaccaggtagcaaccctctgtaccgcccattgtagcacgtgtgtagccctaggcgtaagggccatgatgacctgacgtcatccccaccttcctcact

SEQ ID NO: 1862 - DNA, 220 bp, Unknown
  Description of Unknown: 16S RNA Operational Taxonomic Unit polynucleotide
  Phylum: Gemmatimonadetes; Class: Gemmatimonadetes
aaggtccgggaacgtattcaccgtggtgtagctgacccacgattactagcgattccggcttcatgcagtcgagttacagactgcaatccgaacttggaccaggtttttgcgattcgctccgcctcgcggcctcgctgcgctttgtcctggccattgtagcacgtgtgtagccctgggcgtaaggaccatgatgacttgacgtcgtccccaccttcctccg

SEQ ID NO: 1863 - DNA, 220 bp, Unknown
  Description of Unknown: 16S RNA Operational Taxonomic Unit polynucleotide
  Phylum: TM7; Class: TM7-1
aaagacccgggaacgtattcacggtagtatagctgacctaccgttactagcgattccgacttcaagcaggcgagtttcagcctgctatccgaactgggaccggctttgatgggatttgctccgtctcgcgacttggctgccctttgtaccggccattgtagcgtgtttgtagccccagacgtaagggaatactgacctgacatcatcccctcttcctccc

SEQ ID NO: 1864 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcggcatgctgatccgcgattactagcgattccaacttcacgcagtcgagttgcagactgcgatccggactacgatgcactttctgggatttgctccccctcgcggtggcagccctctgtatgcaccattgtatgacgtgtgaagccctacccataagggccatgaggacttgacgtcactccccaccttcctccggt

SEQ ID NO: 1865 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
acaaggcctgggaacgtattcaccgcggcatgctgatccgcgattactagcgattccgccttcatgctctcgagttgcagagaacaatccgaactgagacggctttttgggattagcttcccctcgcgaggtagcagcccgttgtcaccgccattgtagcacgtgtgtagcccagcgcgtaagggccatgaggacttgacgtcatccccaccttcctccg

SEQ ID NO: 1866 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgctctcgagttgcagagaacaatccgaactgagacggcttttggagattagctcaccctcgcggggtcggctgctcactgtcaccgcccattgttagcacgtgtgtagcccagcgcgtaagggccatgaggacttgacgtcatccccaccttcctcc

SEQ ID NO: 1867 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggccgggaacgtattcaccgcgtcattgctgatacgcgattactagtgattccagcttcacggagtcgagttgcagactccgatccgaactgagaacggcttttcgggattggcgcaccatcgctggttggcaacccgctgtaccgtccattgtagcacgtgtgtagccctaggcgtaagggccatgatgacctgacgtcgtccccgccttcctcact

SEQ ID NO: 1868 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Sanguibacteraceae
aaggcccgggaacgtattcaccgcagcgttgctgatctgcgattactagcgactccgacttcatggggtcgagttgcagaccccaatccgaactgagaccggctttttgggtattcgctccacctcgcggtatcgcagccctttgttaccggcccattgtagcatgcgtgaagcccaagacataaggggcatgatgatttgacgtcatcccaccttcctc

SEQ ID NO: 1869 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
gaaggcccgggaacgtattcaccgtggcgatgctgatccacggattactagcgattccagcttcatgccgtcgagttgcagacgacaatccgaactgaggaccggttttgggattgccttggcattgctgcctcggcccccactgtccgacccattgtagcacgtgtgtagccctagacgtaaggaccatgatgacttgacgtcgtccccacttcctccg

SEQ ID NO: 1870 - DNA, 220 bp, Unknown
  Description of Unknown: 16S RNA Operational Taxonomic Unit polynucleotide
  Phylum: Actinobacteria; Class: Actinobacteria; Order: Solirubrobacterales; Family: Solirubrobacteraceae
aaggcccgggaacgtattcaccgcggcaatgctgatccgcgattactagcaactccgccttcatgcaggcgggtttcagcctgcaatccgaaccgagacacgctttgagggattcgctccacctcacggtatcgcagccctctgtacgtgccaatgtagcacgtgtgtagccctggacataaggggcatgatgacttgacgtcatccccaccttctccgt

SEQ ID NO: 1871 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggacggtattcaccgtatcattgctgatatacgattactagcgattccagcttcatggagtcgagttgcagactccaatctgaactgagaaagagttttgtagattagcgccttgtcaccaagtggcagctctttgtctcttcccattgtagcacgtgtgtagcccctgggcataaaggccatgatgacttgacatcatccccctccttcct

SEQ ID NO: 1872 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccggaacgtattcgaccgtagcgttgctgatctacgattactagcgattccagcttcatgcaggcgagttgcagcctgcaatctgaactgagaggggattttgagattggcatcctgtcaccaggtagcagccctttgttccccccattgtagcacgtgtgtagccctgggcataaaggccatgatgacttgacatcatcccctccttcctcacg

SEQ ID NO: 1873 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatggagtcgagttgcagactccaatctgaactgagagggcgttttttgggattagcttcatatcgctatgttgcagtccctttgtacgcccattgtagcacgtgtgtagccctgggcataaaggccatgatgacttgacatcatcccccttcctcacg

SEQ ID NO: 1874 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacggcgtcgtagctgatacgccattactagcgattccggcttcatggagtcgagttgcagactccaatccgaactgggctcagttttactggattcctccacctcgcggtctcggatcgttctgtactgagcattgtagtacgtgtgcagccctggccgtaagggccatactgacttgacgtcgtcccccaccttcctccc

SEQ ID NO: 1875 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggccggacgtatcgacggcgccgtagctgatgcgccattactagcgattccggcttcatggagtcgagttgcagactccaatctgaactgggcccagttttagagatttcctccaccttgcggtctcggatcgttctgtgctgggcattgtagtacgtgtgcagcccaggccgtaagggccatactgacttgacgtcgtccccaccttcctccccgtt

SEQ ID NO: 1876 - DNA, 220 bp, Unknown
  Description of Unknown: 16S RNA Operational Taxonomic Unit polynucleotide
  Phylum: Proteobacteria; Class: Alphaproteobacteria
aaggcccgggaacgtattcaccgcagcctgctgttctgcgattactagcgattccaccttcatgcactcgagttgcagagtgcaatctgaactgggacggtttttgggattagccgctcgtcgccgagtagcagcccactgtcaccgccattgtagcacgtgtgtagcccagggtgtaagggccatgaggacttgacgtcatccccaccttcctccggct

SEQ ID NO: 1877 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcagcaatgctgatctgcgattactagcgattccgacttcatggagtcgagttgcagactccaatccggactgggatagggtttctgggattggctcaccctcgcgggattgcggccctctgtccctaccattgtagtacgtgtgtagccctggccgtaaggccatgatgacttgacgtcatccccacttcctccggc

SEQ ID NO: 1878 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaacttgagaggcgttttttgggattggctccttatcgctaagtggcagccctttgtacgccccattgtagcacgtgtgtagccctgggcataaaggcccatggatgacttgacatcatcccctccttcct

SEQ ID NO: 1879 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatggaggcgagttgcagcctccaatccgcactgagatcggcttttgggattggctcccctcgcggtttgcagccctctgtaccgatcattgtagcacgtgtgtagccctagacgtaaggaccatgatgacttgacgtcgtccccaccttctccgggtt

SEQ ID NO: 1880 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Haliangiaceae
aaggcccgggaacgtattcacccctgcctgctgatcagggattactagcgattccgacttcatgaagtcgagttgcagacttcaatctgaactgaggccggttttttgggattggcttgccctcgcgggtttgcgaccctttgtaccggtcattgtagcacgtgtgtagccctgggcataagggccatgaggacttgacgtcatccccaccttcctccgt

SEQ ID NO: 1881 - DNA, 220 bp, Unknown
  Description of Unknown: 16S RNA Operational Taxonomic Unit polynucleotide
  Phylum: Armatimonadetes; Class: Chthonomonadetes; Order: Chthonomonadales; Family: Chthonomonadaceae
aaggcccgggaacgtattcactgccgcttatctgatcggcaattactagcgattccgacttcacgcaggcgagttgcagcctgcgatctgaactgggaacggatttttgtagattgcctccacctcgcggtctcggatccctttgtctaccgtccattgtagcatgttttgtagcccagggcgtaagggccatgctgacttgacgtcgtcctcaccttcc

SEQ ID NO: 1882 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggcccgggaacgtattcaccgcgtcattgctgatacgcgattactagcaattccggcttcatgcaggcgagttgcagcctgcaatccgaactacgaacggctttatgagattggctccacctcgcggtctcgcgtctctttgtaccgcccattgtagcacgtgtgtagcccaagacataaggggcatgatgatttgacgtcatccccgccttcctccg

SEQ ID NO: 1883 - DNA, 220 bp, Unknown
  Description of Unknown: 16S RNA Operational Taxonomic Unit polynucleotide
  Phylum: Verrucomicrobia
aaggcccgggaacgtattcacgccgtcgtagctgatacggcattactagcgattccagcttcatgcaggcgagttgcagcctgcaatctgaactgagcccagttttttgggatttccttgccgtcgccggcttggttcctctgtactgggcattgtagtacgtgtgcagccctaggcgtaagggccatgctgacttgacgtcatccccacttcctccccg

SEQ ID NO: 1884 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccgacttcatgcactcgagttgcagagtgcaatccgaactgagacgacttttaggattagctcccctcgcaggtttgcagccctctgtagtcgccattgtagcacgtgtgtagcccacccgtaagggccatgaggacttgacgtcatccccaccttcctccggctta

SEQ ID NO: 1885 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
aaggcccgggaacgtattcaccggatcatggctgatatccgattactagcgattccagcttcacggagtcgagttgcagactccgatccgaactgtgaccggctttgtagattcgctcctggtcacccagtggctgctctctgtaccggccattgtagcacgtgtgtagcccaaggcgtaagggccgtgatgatttgacgtcatccccttcctcacagtg

SEQ ID NO: 1886 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
acaaggtccgggaacgtattcaccgtatcattgctgatatacgattactagcgattccagcttcatgaggtcgagttgcagacctcaattcgaactgagacgagttttttgagattagcatcctgttaccaggtagcaaccctttgtactcgccattgtagcacgtgtgtagccctgggcataaaggccatgatgacttgacatcatcccctccttcctc

SEQ ID NO: 1887 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccaacttcacgccctcgagttgcagaggacgatccgaactgagacgacttttagggatttaccctctgtagtcgccattgtagcacgtgtgtagcccaccccgtaagggccatgaggacttgacgtcatccccaccttcctctcggcttagcaccggcagtccctct

SEQ ID NO: 1888 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aaagacccgggaacgtattcaccgcagcaatgctgatctgcgattactagcgattccgacttcatggagtcgagttgcagactccaatccggactacgacaagttttctgggattagctcccgtcgccggttggcttccctctgtacttgccattgtagcacgtgtgtagccctgtcataaaggccatgatgacttgacgtcatccccacttcctccggt

SEQ ID NO: 1889 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggcccgggaacgaattcaccgcggcatgctgatccgcgattactagcaattccggcttcatgcaggcgagttgcagcctgcaatccgaactacgaacggctttctgggattggcttcacctcgcggcttcgctaaccctttgtaccgtccattgtagcacgtgtgtagcccaggacagtaaggggcatgatgatttgacgtcatccccgcctttcctc

SEQ ID NO: 1890 - DNA, 220 bp, Unknown
  Description of Unknown: 16S RNA Operational Taxonomic Unit polynucleotide
  Phylum: Acidobacteria; Class: Chloracidobacteria
aagatccgggaacgtattcaccgcaacatgctgatttgcgattactagcgattccaacttcatgaagtcgagttgcagacttcaatccgaactgagaccggtttttgcgattagctccctcttgcgagattgcgacgttttgtaccggccattgtagcacgtgtgtagccctgaacataaaggccatgatgacttgacatcatccccaccttcctccgtt

SEQ ID NO: 1891 - DNA, 220 bp, Unknown
  Description of Unknown: 16S RNA Operational Taxonomic Unit polynucleotide
  Phylum: Chloroflexi; Class: SOGA31
aagcccggaacatattcaccgccgtatgctgaccggcggttactagcaactccggcttcatgcaggcgagttgcagcctacaatccgaactgagaccggctttaagggatttgctccacctcgcggtttcgccgcccgttgtaccggccattgtagcgtgggtgtagcccaggacgtaagggccatgctgacttgacgtcatccccgccttcctccgagt

SEQ ID NO: 1892 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgtattcaccgcggcaatgctgatccgcgattactagcaactccgccttcatggaggcgagtttcagcctccaatccgaaccgggaccggctttttgggattcgctcccccctcacgggtttgcagcctttgtaccggccaatgtagcacgtgtgtagccctagacataaggggcatgatgacttgacgtcatccccaccttcctccc

SEQ ID NO: 1893 - DNA, 220 bp, Unknown
  Description of Unknown: 16S RNA Operational Taxonomic Unit polynucleotide
  Phylum: Actinobacteria; Class: Actinobacteria; Order: MC47
aggacccgggaacatattcaccgcggcattgctgatccgcgattactagcaactccgccttcatggaggcgagtttcagcctccaatccgaaccgagaccgactttttgggattcgctccgcctcgcggcatcgcagccctctgtatcggccaatgtagcacgtgtgtagcccaggacataaggggcatgatgacttgacttcgaccccaccttcctccg

SEQ ID NO: 1894 - DNA, 220 bp, Unknown
  Description of Unknown: 16S RNA Operational Taxonomic Unit polynucleotide
  Phylum: Armatimonadetes; Class: CH21
aagacccgggaacgtattcaacgcagtatagctgacctgcgtttactagcgattccgccttcatgcagtcgagttgcagactgcaatctgaactggggcgtatttggatttgctccactcgcggtattgctgcccattgtttcgcccattgtagcatgtgtgaagccccaggcgtaactgccatgctgacttgacgtcatcctcaccttcctccggctta

SEQ ID NO: 1895 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggcttttttgggatttgctcactctcgcgagttttgctgcccgttgtcaccgccatttgtagcacgtgtgtagcccagcgcgtaagggccatgaggacttgacgtcatccccaccttcctcg

SEQ ID NO: 1896 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccggaacgtattcgaccgcagcgtgctgatctgcgattactagcgattccgacttcatggggtcgagttgcagaccccaatccgaactgagacggcttttttgagatttgcgcaggattgctccattgcgtcccactgtcaccgccattgtagcacgtgtgtagcccagcccgtaagggccatgaggacttgacgtcatccccacttcctcgcgg

SEQ ID NO: 1897 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacaagctttttccgattggctccccattgctggtttgcagcggtttgtacttgccattgtagcacgtgtgtagccctggacataaaggccatgaggacttgacgtacactcccccaccttcctt

SEQ ID NO: 1898 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaaggcccggggaacgtattcaccgcagcgtgctgatctgcgattactagcgattccaacttcatggggtcgagttgcagaccccaatccgaactgagacggattttttgagatttgcgaagggtcgcccctttgcatccctctgtcaccgccattgtagcacgtgtgtagcccagcccgtaagggccatgaggacttgacgtcatccccaccttcctcc

SEQ ID NO: 1899 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcatgcaggcgagttgcagcctgcaatccgaactgagacagactttctccgattagctccaccttgcggtctcgcgacggtttgtatctgccattgtagcacgtgtgtagccccagacataaaggccatgcctgaacttgacgtcatccccacttcctccg

SEQ ID NO: 1900 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcgccattgctgatgcgcgattactagcgattccaacttcatgcaggcgagttgcagcctgcaatccgaactgagacatccttttgtgattggctttccatcgctggatcgcaacactctgtagatgccattgtagcacgtgtgtagccctgggcgtaagggccatgatgacttgacgtcatcccctccttcctctcc

SEQ ID NO: 1901 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacggcgccgtagctgatgcgccattactagcgattccggcttcatggagtcgagttgcagactccaatccgaactgggctcagttttactagattcctccacctcgcggtctcggatcgttctgtactgagcattgtagtacgtgtgcagcccaggccgtaagggccatactgacttgacgtcgtcccacttcctcccgtt

SEQ ID NO: 1902 - DNA, 220 bp, Unknown
  Description of Unknown: 16S RNA Operational Taxonomic Unit polynucleotide
  Phylum: Actinobacteria; Class: Actinobacteria; Order: Solirubrobacterales; Family: Patulibacteraceae
aagacccgggaacgtattcaccgcggcaatgctgatccgcgattactagcaactccaccttcatgcaggcgggtttcagcctgcaatccgaaccgagacgcgctttgagggattcgctccacctcgcggtatcgcagccctctgtacgcgccaatgtagcacgtgtgtagccctgggcataaggggcatgatgacttgacgtcatccccaccttcctcac

SEQ ID NO: 1903 - DNA, 220 bp, Unknown
  Description of Unknown: 16S RNA Operational Taxonomic Unit polynucleotide
  Phylum: Acidobacteria; Class: iii1-8; Order: DS-18
aaggcccgggaacgtattcaccgcggcgtgctgatccgcgattactagcgattccagcttcatgcagtcgagttgcagactgcaatccgaactgagaacggcttatgagattagctccacctcgcggttttgcgactctttgtaccgtccattgtagcacgtgtgtagcccggacataaaggccatgaggacttgacgtcatccccactcctccggttat

SEQ ID NO: 1904 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggcccgggaacgtattcaccgcagcgttgctgatctgcgattactagcgactccgacttcacgcagtcgagttgcagactgcgatccgaactagaccggcttaagggatcgctccacctcgcggtatcgcagccctctgtaccagccattgtagcatgtgtgaagccctggacataaggggcatgatgacttgacgtcatccccaccttcctccgagt

SEQ ID NO: 1905 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aagacccgggaacgtattcaccgtggcgtagctgatccacgattactagcgattccagcttcatggaggcgagttgcagcctccaatccgcactgaggtcggctttatgggattggcttgccatcgctggctcgcaaccctttgtaccggccattgtagcacgtgtgtagccctagacgtaaggaccatgatgacttgacgtcgtccccaccttcctccg

SEQ ID NO: 1906 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aaggcccggaacgtattcaccgcagcgttgctgatctgcgattactagcgactccgacttcatgaggtcgagttgcagacctcaatccgaactgagaccggcttttgggattcgctccaccttacggtattgcagccctttgtaccggccattgtagcatgcgtgaagcccaagacataaggggcatgatgatttgacgtcatcccaccttcctccgagt

SEQ ID NO: 1907 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccaacttcatggggtcgagttgcagaccccaatccgaactgagacggctttttgagattgcgaaggattgctcccttgcatccctctgtcaccgccattgtagcacgtgtgtagcccagcccgtaagggccatgaggacttgacgtcatccccaccttcctccggct

SEQ ID NO: 1908 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccaacttcatgccgtcgagttgcagacggcaatctgaactgggcccaatttctgggatttgctcacctgacggtcttgcttccctttgtgttgggcattgtagtacgtgtgcagccctggccgtaagggccatactgacttgacgtcatcccacttcctcccgtta

SEQ ID NO: 1909 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgtattcaccgcggcgttgctgatccgcgattactagcaactccgccttcatggaggcgagttgcagcctccaatccgaaccgggaccggcttttgggattcgctcaacctcacggtattgcagccctttgtaccggccaatgtagcacgtgtgtagcccaagacttaaggggcatgatgacttgacatcatccccaccttccccgac

SEQ ID NO: 1910 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccggaacgtattcaccgtatcattgctgatatacgattactagcgattccagcttcacgcagtcgagttgcagactgcgatctgaactgagagagggtttttagattggctccttatcgctaagtggcagctcttgtcctcccattgtagcacgtgtgtagccctgggcataaaggccatgatgacttgacatcatcccctccttcctcgcgtct

SEQ ID NO: 1911 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatggagtcgagttgcagactccaatccggactacgacgcgctttgtgggattggctccacctcgcggcttggcaaccctctgtacgcgccattgtattacgtgtgaagcccctaccataaagggccatgaggacttgacgtcatccccaccttcccccc

SEQ ID NO: 1912 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggacccgggaacgtattcaccgcagcgttgctgatctgcgattactagcgactccgacttcatggggtcgagttgcagaccccaatccgaactgagaccggctttttgggattcgctccaccttgcggtatcgcagccctttgtaccggccattgtagcatgcgtgaagccctaggcataaggggcatgatgacttgacgtcatccccacttcctccg

SEQ ID NO: 1913 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobia subdivision 3
aaggcctgggaacgtattcacggcgccgtagctgatgcgccattactagcgattccaacttcatgccgtcgagttgcagacggcaatctgaactgggcccggttttctggatttgctccacctgacggtcttgcttccctttgtaccgggcattgtagtacgtgtgcagccctggcccgtaagggcccatactgacttgacgtcatccccacttcctcct

SEQ ID NO: 1914 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcattgctgatctgcattactagcgactccgacttcacggggtcgagttgcagaccccgatccgaactgagaccggctttgtgggattcgctccacctcacggcttcgcagccctctgtaccggccattgtagcatgtgtgaagccctggacataaggggcatgatgacttgacgtcgtccccaccttctccgag

SEQ ID NO: 1915 - DNA, 220 bp, Unknown
  Description of Unknown: 16S RNA Operational Taxonomic Unit polynucleotide
  Phylum: WS3; Class: PRR-12; Order: Sediment-1; Family: PRR-10
aaggcccgggaacgtattcaccgctgcctgctgatcagcgattactagcgattccgacttcatgcagtcgagttgcagactgcaatccgaactgagaccggttttttgggattggctccacctcgcggtatcgcagccctttgtaccggccattgtagcacgtgtgtagccccagacgtaagggccatgaggacttgacgtcatccccaccttcctccgc

SEQ ID NO: 1916 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgcaggcgagttgcagcctgcaatctgaactgagagacgtttttgggattagcttcacatcgctgtgttgcagccctttgtacgcccattgtagcacgtgtgtagccctgggcataaggccatgatgacttgacatcatcccccttcctcgcgtctt

SEQ ID NO: 1917 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggccagggaacgaattcaccgcggcatgctgatccgcgattactagcaattccggcttcatgcaggcgagttgcagcctgcaatccgaactacgaacggctttatgagattggctccacctcgcggtctcgcatctctttgtaccgcccattgtagcacgtgtgtagcccaagacataaggggcatgatgatttgacgtcatccccgccttcctccgg

SEQ ID NO: 1918 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaaggcccgggaacgtattcaccgcagcaatgctgatctgcgattactagcgattccgacttcacggagtcgagttgcagactccgatccggactgagatggggtttctgggattggctcaccctcgcgggattgcagccctctgtccccacattgtagtacgtgtgtagccctggccgtaagggccatgatgacttgacgtcatccccaccttctccgg

SEQ ID NO: 1919 - DNA, 220 bp, Unknown
  Description of Unknown: 16S RNA Operational Taxonomic Unit polynucleotide
  Phylum: Acidobacteria; Class: Chloracidobacteria
aagacccgggacgtattcaccgcagcatgctgatctgcgattactagcgattccaacttcatgaagtcgagttgcagacttcaatccgaactgagaccggcttttccgattggctccctttgcaggtttgcagcggtttgtaccggccattgtagcacgtgtgtagccctggacataaaggccatgaggacttgacgtcatccccacttcctccgttttg

SEQ ID NO: 1920 - DNA, 220 bp, Unknown
  Description of Unknown: 16S RNA Operational Taxonomic Unit polynucleotide
  Phylum: Chloroflexi; Class: Bljii12; Order: B07_WMSP1; Family: FFCH4570
aaggcctgggaacgtattcactgccatgtgctgactggcagttactagcaactccgacttcatgcaggcgagttgcagcctgcaatccgaactgagaccggctttggtgggattagctccaggtcgccccttggcagcccgttgtaccggccattgtagcgtgtgtgtagccctcgacgtaagagccgtgctgacttgacgtcatccccaccttcctccg

SEQ ID NO: 1921 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
aaggcccgggaacgtattcaccgcgtcattgctgatacgcgattactagcgaatccaacttcacggggtcgagttgcagaccccgatccgaactgtgaatggctttatggagatggcatcctgttgccaggtagctgccctctgtaccatccattgtagcacgtgtgtagccccggacgtaagggccatgatgacttgacgtcgtcccctccttcctctc

SEQ ID NO: 1922 - DNA, 220 bp, Unknown
  Description of Unknown: 16S RNA Operational Taxonomic Unit polynucleotide
  Phylum: Proteobacteria; Class: Deltaproteobacteria; Order: Syntrophobacterales; Family: Syntrophobacteraceae
aaggcccgggaacgtattcaccgcggcatgctgatccgcgattactagcgattccagcttcacggagtcgagttgcagactccgatccgaactgagggcggttttgtgggattggctccgcctcgcggcctcgcctccctctgtaccgcccattgtagcacgtgtgtagccctgggtataaaggccatgatgacttgacgtcgtcccccttcctcccgcc

SEQ ID NO: 1923 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggccggaacgtattcaccgcggcatgctgatccgcgattactagcgattccaacttcatgctctcgagttgcagagaacaatccgaactgagacgacttttagggattggctccccctcgcgggattgcagaccctctgtagtcgccattgtagcacgtgtgtagcccaccttgtaagggccatgaggacttgacgtcatccccgccttcctccggat

SEQ ID NO: 1924 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcatgctgatccgcgattactagcgattccgacttcatgcagtcgagttgcagactgcaatccggactacgaccggctttcacgggatttggctccccctcgcgggttggcaaccctctgtaccggccattgtatgacgtgtgaagccctacccataagggccatgaggacttgacgtcatcccccaccttcctc

SEQ ID NO: 1925 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctggaacgtattcaccgcggcatgctgatccgcgattactagcgattccgccttcatgccctcgagttgcagaggacaatccgaactgagacgacttttggagattagctcacccttgcgggatagctgcccactgtcatcgccattgtagcacgtgtgtagcccagcttgtaagggccatgaggacttgacgtcatccccaccttctccggctt

SEQ ID NO: 1926 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Cellulomonadaceae
aaggccccgggaacgtattcaccgcagcgttgctgatctgcgattactagcgactccgacttcatgaggtcgagttgcagacctcaatccgaactgagaccggctttttgggattcgctccaccttacggcatcgcagccctttgtaccggccattgtagcatgcgtgaagcccaagacataaggggcatgatgatttgacgtcatcccccaccttcctc

SEQ ID NO: 1927 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
acaaggcccggaacgaattcactgcagtatgctgacctgcaattactagcgattcctccttcacgcaggcgagttgcagcctgcgatctgaactgagcgccgatttccgggatttgcttgctatcgctagcttgctgccctctgttcggcgcattgtagtacgtgtgtagcccaagacgtaaggggcatgctgacttgacgtcatccccacttcctccgg

SEQ ID NO: 1928 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aagggcccgggaacgtattcaccgcagcaatgctgatctgcgattactagcgattccgacttcatggagtcgagttgcagactccaatccggactgagaaagggtttctgggattcggctcaccctcgcgggatcgcggccctctgtcccttccattgtagtacgtgtgtagccctggccgtaagggccatgatgacttgacgtcatccccaccttcctc

SEQ ID NO: 1929 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggccgggaacgtattcaccgcggcaatgctgatccgcgattactagcgattccgacttcacggagtcgagttgcagactccgatccggactaggatggggtttctgggattggctccggctcgcgccttggcgaccctctgtccccaccattgtagtacgtgtgtagccctggccgtaagggccatgatgacttgacgtcatcccaccttcctccgtt

SEQ ID NO: 1930 - DNA, 220 bp, Unknown
  Description of Unknown: 16S RNA Operational Taxonomic Unit polynucleotide
  Phylum: TM7; Class: TM7-1
aagacccgggaacgtattcacggtagtatagctgacctaccgttactagcgattccgacttcaagcaggcgagtttcagcctgctatccgaactgggaccggctttgatgggatttgctccgtcttgcgacttggctgccctttgtaccggccattgtagcgtgtttgtagccccaggcgtaagggaaatactgactgacatcatcccctcttcctccct

SEQ ID NO: 1931 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatggaggcgagttgcagcctccaatccgcactgaggccggctttaagggattggcttgctatcgctagctcgcaacccgctgtaccggccattgtagcacgtgtgtagccctagacgtaaggaccatgatgacttgacgcgtcccaccttcctccggt

SEQ ID NO: 1932 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatccgaactgagaagcgttttttgggattagctacacgtcaccgtgttgcagccctttgtacgctccattgtagcacgtgtgtagccctgggcataaaggccatgatgacttgacatcatcccctccttcctcac

SEQ ID NO: 1933 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagggtccgggaacgtattcaccgtagcgttgctgatctacgattactagcgattccagcttcatgcaggcgagttgcagcctgcaatccgaactgagagtgcgttttgggaattagctccttgttgccaagtggcagccctttgtcgcacccattgtagcacgtgtgtagccctgggcataaaggccatgatgacttgacatcatcccctcttcctcac

SEQ ID NO: 1934 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
acaaggcccgggaacgtattcaccgcagcgtgctgatctgcgattactagcgattccaacttcatgtgctcgagttgcagagcacaatccgaactgagacggcttttggagatttgctagggattgctccttggcatccctctgtcaccgccattgtagcacgtgtgtagcccagcctgtaagggccatgaggacttgacgtcatccccaccttcctccg

SEQ ID NO: 1935 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcgacaatgctgattcgcgattactagcgattccgacttcacggagtcgagttgcagactccgatccggacacgaccggctttctgggattggctcccgcttgcgcgttggcaaccctttgtaccggccattgtagcacgtgtgtagccctggccataaaggccatgatgacttgacgtcatccccacttctccggtt

SEQ ID NO: 1936 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggcccggaacgtatcgaccgctgcctgctgatcagcgattactagcgattccgacttcatgtactcgagttgcagagtacaatctgtactgaggtgcactttttgcgattggcttactctcgcgagcttgctgcgctctgtatgcaccattgtagcacgtgtgtagccctggacataagggccatgaggacttgacgtcgtccccaccttcctccggc

SEQ ID NO: 1937 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacgccgtcgtagctgatacggcattactagcgattccggcttcatggagtcgagttgcagactccaatccgaactgggcccagtttactggatttcctccaccttgcggtctcggatcgttctgtactgggcattgtagtacgtgtgcagccctggccgtaagggccatactgacttgacgtcgtccccacttcctcccct

SEQ ID NO: 1938 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggccggacgtattcaccgcggcgtgctgatccgcgattactagcgattccaacttcaagcaggcgagttgcagcctgctatccgaactgagaccggctttctccgattagctccaccttacggtatcgcgacggtttgtaccggccattgtagcacgtgtgtagccccagacataaaggccatgctgacttgacgtcatccccaccttcctccggttt

SEQ ID NO: 1939 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcatgctgatccacgattactagcgattccaacttcatgggctcgagttgcagagcccaatccgaactgagacggcttttgagatttgcgaagggtcgccccttagcatcccattgtcaccgccattgtagcacgtgtgtagcccagcccgtaagggccatgaggacttgacgtcatccccacctctcgcggcta

SEQ ID NO: 1940 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagtacgttttttgggattagctccttatcactaagtggcagccctttgtacgccccattgtagcacgtgtgtagccctgggcataaaggccatgatgacttgacatcatccccctcttcctcg

SEQ ID NO: 1941 - DNA, 220 bp, Unknown
  Description of Unknown: 16S RNA Operational Taxonomic Unit polynucleotide
  Phylum: Cyanobacteria; Class: Synechococcophycideae; Order: Synechococcales; Family: Acaryochloridaceae
aaggcccgggaacgtattcaccgcagtatgctgacctgcgattactagcgattccgccttcatgcaggcgagttgcagcctgcaatctgaactgagccgtggttatgggattagctcactctcgcgagttggcaaccctttgtccacagcattgtagtacgtgtgtagcccaggacgtaagggcatgctgacttgacgtcatccccaccttcctccccgc

SEQ ID NO: 1942 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobia subdivision 3
aaggcctgggaacgtattcacggcgccgtagctgatgcgccattactagcgattccagcttcatgccgtcgagttgcagacgacaatctgaactgggcccggttttggggatttgctccaccttacggtctcgcttccctttgtgccgggcattgtagtacgtgtgcagccctggccgtaagggccatactgacttgacgtcatcccacttcctcctccg

SEQ ID NO: 1943 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobia subdivision 3
aaggcctgggaacgtattcacggcgccgtagctgatgcgccattactagcgattccagcttcatgaaggcgagttgcagccttcaatctgaactgggcccggtttttggggatttgctccacctcgcggtcttgcttccctttgtgccgggcattgtagtacgtgtgcagccctggccgtaagggccatactgacttgacgtcatccccacttcctccca

SEQ ID NO: 1944 - DNA, 220 bp, Unknown
  Description of Unknown: 16S RNA Operational Taxonomic Unit polynucleotide
  Phylum: Chloroflexi
aagacccgggaacgtattcaccgccgtgtgctgaccggttactagcaactccgacttcatgcaggcgagttgcagcctgcaatccgaactgagaccgcgtttgctgcgattcgctccaggtcgccccttcgcggcgcattgtcgcggccattgtagcgtgtgtgtagccctggacgtaagggccgtgctgacttgacgtcatccccgccttcctccgggt

SEQ ID NO: 1945 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
gaggcccgggaacgtattcaccgcgacaatgctgattcgcgattactagcgattccgacttcacggagtcgagttgcagactccgatccggactgagatcggctttctgggattggctccgcctcgcggcattgcgaccctctgtaccgaccattgtagtacgtgtgtagccctggccgtaagggccatgatgacttgacgtcatccccacttcctccgg

SEQ ID NO: 1946 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggcccggaagtattcgaccgcgagcgttgctgatctgcgattactagcgactccgacttcacggggtcgagttgcagaccccgatccgaactgagaccagctttttgggattcgctccacctcacggtctcgcagccctttgtactggccattgtagcatgcgtgaagcccaagacataaggggcatgatgatttgacgtcgtcccaccttcctccga

SEQ ID NO: 1947 - DNA, 220 bp, Unknown
  Description of Unknown: 16S RNA Operational Taxonomic Unit polynucleotide
  Phylum: Actinobacteria; Class: Actinobacteria; Order: MC47
agggcccgggaacgtattcaccgcggcgttgctgatccgcgattactagcaactccgccttcatggaggcgagttgcagcctccaatccgaaccgggaccggctttttgggattcgctcaacctcgcggttttgcagccctttgtaccggccaatgtagcacgtgtgtagcccaagacataaggggcatgatgacttgacctcatcccccttcctccgac

SEQ ID NO: 1948 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Rhizobiaceae
aaggcccgggacgtattcaccgtggcattctgatccacgattactagcgattccaacttcatgcactcgagttgcagagtgcaatccgaactgagatggctttggagattagctcgacctcgcggtctcgctgcccactgtcaccaccattgtagcacgtgtgtagcccagcccgtaagggccatgaggacttgacgtcatccccaccttcctctcggct

SEQ ID NO: 1949 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcggcaatgctgatccgcgattactagcgattccgacttcacgcagtcgagttgcagactgcgatccggactgagatagggtttctgggattggctccgcctcgcggcatcgcgaccctctgtccccaccattgtagtacgtgtgtagccctggtcgtaagggccatgatgacttgacgtcatccccacttcctccgg

SEQ ID NO: 1950 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccggaacgtattcaccgcgggcatgctgatccgcgattactagcgattccaacttcatgcactcgagttgcagagtgcaatccgaactgagacgacttttagggattggcctccccctcgcgggattgcagccctctgtagtcgccattgtagcacgtgtgtagcccaccttgtaagggccatgaggacttgacgtcatccccacttcctccggc

SEQ ID NO: 1951 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcggcgttctgatccgcgattactagcgattccagcttcatggagtcgggttgcagactccaatccgaactgaggccggctttttccgatttagctcccttcgcaggtttgcgacggtttgtaccgaccattgtagcacgtgtgtagccctggacataaaggccatgaggacttgacgtcatccccacttcctccccg

SEQ ID NO: 1952 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aggcccggacgtattcaccgcagcgtgctgatctgcgattactagcgattccaacttcatgtgctcgagttgcagagcacaatccgaactgagacggctttttgagatttgcgaaggattactcctttgcgtccctctgtcaccgccattgtagcacgtgtgtagcccagcctgtaagggccatgaggacttgacgtcatccccacttcctccggcttat

SEQ ID NO: 1953 - DNA, 220 bp, Unknown
  Description of Unknown: 16S RNA Operational Taxonomic Unit polynucleotide
  Phylum: Acidobacteria; Class: Chloracidobacteria
aagacccgggacgtattcaccgcagcgttctgatctgcgattactagcgattccaacttcatgaagtcgagttgcagacttcaatccgaactgagaccggttttgcgattagctccctcttgcgagattgcgacgttttgtaccggccattgtagcacgtgtgtagccctgaacataaaggccatgatgacttgacatcatccccactcctccgtttatc

SEQ ID NO: 1954 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgtgctgatctgcgattactagcgattccagcttcatggagtcgagttgcagactccaatccgaactggggacgctttttccgattagctccccctcacgggtttgcgacggttgtaccgaccattgtagcacgtgtgtagccctggacataaaggccatgaggacttgacgtcatcccaccttcctccccgtt

SEQ ID NO: 1955 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccggaacgtattcaccgcggcattgctgatccgcgattactagcgattccgacttcacgcagtcgagttgcagactgcgatccggactgggatagggtttctgggattggctccacctcgcggcttcgcgaccctctgtccccaccattgtagtacgtgtgtagccctggccgtaagggccatgatgacttgacgtcatccccaccttcctccgg

SEQ ID NO: 1956 - DNA, 220 bp, Unknown
  Description of Unknown: 16S RNA Operational Taxonomic Unit polynucleotide
  Phylum: Chloroflexi; Class: Bljii12; Order: B07_WMSP1; Family: FFCH4570
gaggcccgggaacgtattcacggctgtgtgctgaccagccgttactagcaactccgacttcacgcaggcgagttgcagcctgcgatccgaactgagaccggctttggtgggattagctccgcctcgcggcttggcagcccgttgtaccggccattgtagcgtgtgtgtagccctcgacgtaagagccgtgctgacttgacgtcatccccaccttcctccg

SEQ ID NO: 1957 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Glycomycetaceae
aaggcccgggaacgcattcaccgcagcgttgctgatctgcgattactagcgactccaccttcatcgagtcgagttgcagactcgaatccgaaccaagaccggctttacagggattcgctccaccctcacggtatcgcaacccgctgtaccggccaatgtagcatgcgtgaacgccctagacagtaagggcatgatgacttgacctcactccccaccttcc

SEQ ID NO: 1958 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
agggcccgggaacgtattcaccgtggcgtagctgatccacgattactagcgattccagcttcatggaggcgagttgcagcctccaatccgaactgaggccgggtttggggattggctcatgcttgcgcatttgcaacccgctgtcccggccattgtagcacgtgtgtagccctagacgtaaggaccatgatgacttgacgtcgtccccaccttcctccgg

SEQ ID NO: 1959 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccaacttcatgcactcgagttgcagagtgcaatccgaactgagacggctttttgagatttgcgcagggttgccccattgcgtcccattgtcacgccattgtagcacgtgtgtagcccaactgtaagggccatgaggacttgacgtcatccccacttcctcgcggctt

SEQ ID NO: 1960 - DNA, 220 bp, Unknown
  Description of Unknown: 16S RNA Operational Taxonomic Unit polynucleotide
  Phylum: Actinobacteria; Class: Actinobacteria; Order: Acidimicrobiales; Family: EB1017
aagacccgggaacgtattcaccgcagcaatgctgatctgcgattactagcgactccgacttcacgcagtcgagttgcagactgcgatccgaactgagaccggctttctgggattggcgtcttctcgcgaagtagcaaccctttgtaccggccattgtagcatgtgtgcagccctggacgtaaggggcatgatgacttgacgtcgtcccccttcctccgtt

SEQ ID NO: 1961 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aagacccgggaacgtattcactgcagtatgctgacctgcaattactagcgattcctccttcacgcaggcgagttgcagcctgcgatctgaactgagccacggtttatgagatttgcttgctatcgctagcttgctgccctttgtccgtagcattgtagtacgtgtgtagcccaagacgtaaggggcatgctgacttgacgtcatccccacttcctccggt

SEQ ID NO: 1962 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggcccgggaacgtattcaccgcgtcattgctgatacgcgattactagcgattccagcttcacgaagtcgagttgcagacttcgatccgaactgagagcggcttttgtagattggcatcctgtcaccaggtagcaaccctcctgtaccgcccacttgtagcacgtgtgtagccctacggcgtaagggccatgatgacctgacgtcatccccaccctccc

SEQ ID NO: 1963 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagatccgggaacgtattcaccgtatcattgctgatatacgattactagcgattccagcttcacgcagtcgagttgcagactgcgatctgaactgagagaaggtttttgagattagctccctgtcaccaggtggcagccctttgtccttcccattgtagcacgtgtgtagccctgggcataaaggccatgatgacttgacatcatcccctcttcctcgcg

SEQ ID NO: 1964 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgagggcgagttgcagccctcaattcgaactgagataggatttttgagattagcatcctgttaccaggtagcagccctttgttcctaccattgtagcacgtgtgtagccctgggcataaagaccgacaggatgacttgacatcatcccctcttcctc

SEQ ID NO: 1965 - DNA, 220 bp, Unknown
  Description of Unknown: 16S RNA Operational Taxonomic Unit polynucleotide
  Phylum: Actinobacteria; Class: Actinobacteria; Order: MC47
aaggcccgagaacgtaggtcaccggcggcgttgctgatccgcgattactagcaactccgccttcatggaggcgagtttcagcctccaatccgaaccgggaccggctttttgggattcgctccccctcacgggtttgcagccctctgtaccggccaatgtagcacgtgtgtagcccgagacgtaaggggcatgatgacttgacgtcatccccacttcctcc

SEQ ID NO: 1966 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccaggaacgtattcacggcgccgtagctgatgcgccattactagcgattccggcttcatggagtcgagttgcagactccaatctgaactgggcccagttttagagatttcctccaccttgcggtctcggatcgttctgtgctgggcattgtagtacgtgtgcagcccaggccgtaagggccatactgacttgacgtcgtccccaccttcctcccg

SEQ ID NO: 1967 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaggcgttttttgggattggctccttatcgctaagtggcagccctttgtacgccccacttgtagcacgtgtgtagccctgggcataaaggccatgatgacttgacatcactcccctccttccct

SEQ ID NO: 1968 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcaatgctgatctgcgattactagcgactccgacttcacggggtcgagttgcagaccccgatccgaactgagaccggctttttccgattcgctccccctcacgggctcgcaacggtttgtaccggccattgtagcatgcgtgaagccctggacataaggggcatgatgacttgacgtcatccccacttctccagt

SEQ ID NO: 1969 - DNA, 220 bp, Unknown
  Description of Unknown: 16S RNA Operational Taxonomic Unit polynucleotide
  Phylum: Chloroflexi
aaggcccgggaacgtattcaccgcaccgtgctgatgtcgcggttactagcaactccgacttcaagcaggcgagttgcagcctgctatccgaactgagaccggctttgtgggattagctccacctcgcggcttcgcagcccctctgtaccggccattgtagcgtgtgtgtagcccagggacgtaagagccatgctgacttgacgtcatccccaccttcctc

SEQ ID NO: 1970 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
acaaggcctgggaacgtattcaccgcggcatgctgatccgcgattactagcgattccgccttcatgctctcgagttgcagagaacaatccgaactgagacggctttggagattagctcaccctcgcgggtttgcagccctctgtcaccgccattgtagcacgtgtgtagccccagcgcgtaagggccatgaggacttgacgtcatccccacttcctccgg

SEQ ID NO: 1971 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaaggcccgggaacgtattcaccgaggcatgctgatcctcgattactagcgattccaacttcatgcactcgagttgcagagtgcaatccgaactgagtacggctttttaggatcggctccggctcgcgccatcgcatcccattgtcaccgccattgtagcacgtgtgtagcccagcccgtaagggccatgaggacttgacgtcatccccacttcctccgg

SEQ ID NO: 1972 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttctggggattgggctccccctcgcgggttggcagccctctgtaccggcccattgtatgacgtgtgtagccctacccataagggccatgaggacctgacgtcatcccaccttcctct

SEQ ID NO: 1973 - DNA, 220 bp, Unknown
  Description of Unknown: 16S RNA Operational Taxonomic Unit polynucleotide
  Phylum: Acidobacteria; Class: iii1-8; Order: DS-18
aaggcccgggaacgtattcaccgcggcgtgctgatccgcgattactagcgattccagcttcatgcagtcgagttgcagactgcaatccgaactgagaacggttttttgagatagctcaacctcgcggtttgtcgactctttgtgccgtccattgtagcacgtgtgtagccctggacataaaggccatgaggacttgacgtcatccccaccttcctccggt

SEQ ID NO: 1974 - DNA, 220 bp, Unknown
  Description of Unknown: 16S RNA Operational Taxonomic Unit polynucleotide
  Phylum: Proteobacteria; Class: Betaproteobacteria
aagacccgggacgtattcaccgcgacatgctgatccgcgattactagcgattccgacttcatgcagtcgagttgcagactgcaatccggactacgacgcgctttaagggattggctccagatcgctccttggcaacctctgtacgcgccattgtattacgtgtgaagccctaccataagggccatgaggacttgacgtcatccccacttctccggtttgt

SEQ ID NO: 1975 - DNA, 220 bp, Unknown
  Description of Unknown: 16S RNA Operational Taxonomic Unit polynucleotide
  Phylum: Proteobacteria; Class: Betaproteobacteria
aagacccggacgtattcaccgcgacatgctgatccgcgattactagcgattccgacttcaaggagtcgagttgcagactcctatccggactacgacgcgctttaagggattggctccacctcgcggcttggcaacctctgtacgcgccattgtattacgtgtgaagccctacccataagggccatgaggacttgacgtcatccccacttcctccggtttg

SEQ ID NO: 1976 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccctcgggttgcagaggacaatccgaactgagggcgggtttacgggattggctccgccttgcgactttgcgaccctttgtcccgcccattgtagcacgtgtgtagcccctggacgtaaggaccatgatgacttgacgtcgtcccacttcctccgt

SEQ ID NO: 1977 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aagacccgggaacgtattcaccgcagcgttgctgatctgcgattactagcgactccgacttcatgaggtcgagttgcagacctcaatccgaactgggaccggctttttgggattcgctccccttacggtatcgcagccctttgtaccggccattgtagcatgcgtgaagccctggacataaggggcatgatgacttgacgtcatcccaccttcctccgag

SEQ ID NO: 1978 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggtttttctgggatggctccccctcgcgggttggcagccctctgtaccggccattgtatgacgtgtgtagccctacccataagggccatgaggacctgacgtcatccccaccttcctccgg

SEQ ID NO: 1979 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Rhizobiaceae
aaggcccggacgtatcgaccgcgagcatgctgatctgcgattactagcgattccaacttcatgcactcgagttgcagagtgcaatccgaactgagatggcttttggagattagctcgacatcgctgtctcgctgcccactgtcaccaccattgtagcacgtgtgtagcccagcccgtaagggccatgaggacttgacgtcatccccacttcctctcggct

SEQ ID NO: 1980 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccggaacgtattcaccgcagcgtgctgatctgcgattactagcgattccaacttcatggggtcgagttgcagaccccaatccgaactgagacggctttttgagatttgcgaagggtcgccctttgcatccctctgtcaccgccattgtagcacgtgtgtagcccagcccgtaagggccatgaggacttgacgtcatccccacttcctccggctta

SEQ ID NO: 1981 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcggcgttctgatccgcgattactagcgattccaacttcatggagtcgagttgcagactccaatccgaactgagaccggtttttgcgattagcttccccttgcgggatcgcgacgttttgtaccggccattgtagcacgtgtgtagccctaagcataaaggccatgatgacttgacatcatccccaccttcctccgtc

SEQ ID NO: 1982 - DNA, 220 bp, Unknown
  Description of Unknown: 16S RNA Operational Taxonomic Unit polynucleotide
  Phylum: Chloroflexi; Class: Ktedonobacteria
aagacccgggaacgtattcaccgtagtgtgctgacctacggttactagcaactccgacttcatgcaggcgggttgcagcctgcaatctgaactgagatcaagtttgctgagattggctccccctcgcgggttggcaactcattgtcctgaccattgtagcgtgtgtgtcgcccaggatgtaagggccgtgctgacttgacgtcatccccaccttcctccg

SEQ ID NO: 1983 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgtattcaccgcggcattgctgatccgcgattactagcaactccgccttcatggaggcgagtttcagcctccaatccgaaccgggaccggcttttttgggatttcgctccccctcgcgggtttgcagcccttttgtaccggccaatgtagcacgtgtgtagccctaggcataaggggcatgatgacttgacatcatccccaccttcct

SEQ ID NO: 1984 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatctgaactgagagatgttttttgagattggcttcacgtcaccgtgttgctgctctttgtacaccccattgtagcacgtgtgtagccctgggcataaaggccatgatgacttgacgtcatccccactcctccggt

SEQ ID NO: 1985 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagcgttgatgcgccattactagcgattccagcttcatgtcgtcgagttgcagacgacaatctgaactgggcccggttttctgggatttgctcacctgacggtcttgctccctttgtgccgggcattgtagtacgtgtgcagccctggccgtaagggccatactgacttgacgtcatccccaccttcctcct

SEQ ID NO: 1986 - DNA, 220 bp, Unknown
  Description of Unknown: 16S RNA Operational Taxonomic Unit polynucleotide
  Phylum: Acidobacteria; Class: iii1-8; Order: DS-18
aaggcccgggaacgtattcaccgcggcgtgctgatccgcgattactagcgattccagcttcatgcagtcgagttgcagactgcaatccgaactgagaatggtttttgagattagctccacctcgcggcatcgcaactctttgtaccatccattgtagcacgtgtgtagccctggacataaaggccatgaggacttgacgtcatccccactcctccggtat

SEQ ID NO: 1987 - DNA, 220 bp, Unknown
  Description of Unknown: 16S RNA Operational Taxonomic Unit polynucleotide
  Phylum: Acidobacteria; Class: iii1-8; Order: 32-20
aaggcccgggacgtattcaccgcggcgtgctgatccgcgattactagcgattccagcttcatggggtcgagttgcagaccccaccgaactgagaccggctttatccgattgctccaacttgcgttctcgcaacggtttgtaccggccattgtagcacgtgtgtagccctggacataaaggccatgaggacttgacgtcatccccaccttcctccggttta

SEQ ID NO: 1988 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcacgtagtcgagttgcagactacgatccggactacgatacactttctggattagctccccctcgcgggttggcggccctctgtatgtaccattgtatgacgtgtgaagccctacccataagggccatgaggacttgacgtcactccccacccttcctccc

SEQ ID NO: 1989 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatggagtcgagttgcagactccaatctgaactgagaagaggtttttgggattagcttcgagtaattactatgttgcagccctttgtcctctccattgtagcacgtgtgtagccctgggcataaaggccatgatgacttgacatcatcccctccttcct

SEQ ID NO: 1990 - DNA, 220 bp, Unknown
  Description of Unknown: 16S RNA Operational Taxonomic Unit polynucleotide
  Phylum: Acidobacteria; Class: Acidobacteria-5
aagacccgggaacgtattcaccgctgcttgctgatcagcgattactagcgattccagcttcatgcagtcgagttgcagactgcaatccgaactgagaatggttttttgagattggctccctctcgcgagtttgcgactcattgtgccatccattgtagtacgtgtgtagccctggacataaaggccatgaggacttgacgtcatcccccttcctccggtt

SEQ ID NO: 1991 - DNA, 220 bp, Unknown
  Description of Unknown: 16S RNA Operational Taxonomic Unit polynucleotide
  Phylum: Verrucomicrobia; Class: Opitutae; Order: Opitutales; Family: Opitutaceae
gaggcccgggaacgtattcacggcgccgtagctgatgcgccattactagcgattccaacttcatgtagtcgagttgcagactacaatctgaactgggctcggttttgaggatttgctccacctcgcggtattgcgtccctctgtgccgagcattgtagtacgtgtgcagccctagccgtaagggccatcctgacttgacgtcatccccacttcccacccc

SEQ ID NO: 1992 - DNA, 220 bp, Unknown
  Description of Unknown: 16S RNA Operational Taxonomic Unit polynucleotide
  Phylum: Acidobacteria; Class: Chloracidobacteria
aagaccgggaacgtattcaccgcaacatgctgatttgcgaattactagcgattccaacttcatgaagtcgagttgcagacttcaatccgaactgagaacggttttagcgattagctccctcttacgagattgcgacgttttgtaccgtccattgtagcacgtgtgtagccctgaacataaaggccatgatgacttgacatcatccccaccttcctccgtt

SEQ ID NO: 1993 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
aaggcccgggaacgtattcaccgcagcattgctgatctgcgattactagcgaatccaacttcacggggtcgagttgcagaccccgatccgaactgtgaccggctttttgagattggcttcctgttgccaggtcgctgccctctgtaccggccattgtagcacgtgtgtagccccggacgtaagggccatgatgacttgacgtcgtcccctccttcctccg

SEQ ID NO: 1994 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aagcccgggacgaattcactgcagtatgctgacctgcaattactagcgattcctccttcacgcaggcgagttgcagcctgcgatctgaactgagctccggtttacgggatttgcttgcattcgcatgcttgctgccctctgtccggagcattgtagtacgtgtgtagcccaaggcgtaaggggcatgctgacttgacgtcatccccaccttcctccggtt

SEQ ID NO: 1995 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggaacgtattcaccgcggcgtgctgatccgcgattactagcgattccaacttcatgcacccgagttgcagagtgcaatccgaactgagatggcttttggagatcggctccgggtcgccccttcgctcccactgtcaccaccattgtagcacgtgtgtagcccagcccactaagggccatgaggacttgacgtcatccccgccttcctccggc

SEQ ID NO: 1996 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggaacgtattcaccgcggcgtgctgatccgcgattactagcgattccgacttcatgctctcgagttgcagagagcaatccgaactgagacggttttttgagattggctcaggctcgcaccctcgctcccctctgtcaccgccattgtagcacgtgtgtagcccagcccataagggccatgaggacttgacgtcatccccgccttctccggct

SEQ ID NO: 1997 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
agggcccgggaacgtattcaccgtggcgtagctgatccacgattactagcgattccagcttcatggaggcgagttgcagcctccaatccgcactgagatcggctttacgggattggcttgccatcgctagctcgcaaccctttgtaccgatcattgtagcacgtgtgtagccctagacgtaaggaccatgatgacttgacgtcgtccccaccttcctccg

SEQ ID NO: 1998 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgagtctacggaattactagcgattccagcttcatggagtcgagttgcagactccaatctgaactgagaggcgttttttgggattagcttcatattgctatgttgcagccctttgtacgccccattgtagcacgtgtgtagccctgggcataaaggccatgatgacttgacatcatcccctcttcctc

SEQ ID NO: 1999 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacgccgtcgtagctgatacggcattactagcgattccggcttcatggaggcgagttgcagcctccaatccgaactgagcccagttttactagatttcctccctcgcggtctcggatcgttctgtactgggcattgtagtacgtgtgcagccctggccgtaagggccatactgacttgacgtcgtccccacttcctccccgt

SEQ ID NO: 2000 - DNA, 220 bp, Unknown
  Description of Unknown: 16S RNA Operational Taxonomic Unit polynucleotide
  Phylum: Acidobacteria; Class: iii1-8; Order: 32-20
aaggcctgggaacgtattcaccgcggcgtgctgatccgcgattactagcgattccagcttcatggggtcgagttgcagaccccaatccgaactgagaccggctttatccgatttgctccagcttgcgctctcgcaacggtttgtaccggccattgtagcacgtgtgtagccctggacataaaggccatgaggacttgacgtcatccccaccttcctccgg

SEQ ID NO: 2001 - DNA, 220 bp, Unknown
  Description of Unknown: 16S RNA Operational Taxonomic Unit polynucleotide
  Phylum: Chloroflexi
aaggcccgggaacgaattcaccgcgctatgctgacacgcggttactagcaactccgacttcatgcactcgggttgcagagtgcaatctgaactgaggcaccctttggaggtctgctctccctcgcgggatggcttctcactgtaagtgccattgtagcgtgtgtgtagcccaggacgtaagagccatgctgacttgacgtcatccccaccttcctcccct

SEQ ID NO: 2002 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagacccgggaacgtattcaccgtagcgttgctgatctacgattactagcgattccagcttcatgcaggcgagttgcagcctgcaatctgaactgagagaggttttttgagattagcatcctgtcaccaggtagcagccctttgtccccccattgtagcacgtgtgtagccctgggcataaaggccatgatgacttgacatcatcccctccttcctcacg

SEQ ID NO: 2003 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aagacccgggaacgtattcaccgcggcgtagctgatccgcgattactagcgattccagcttcatggaggcgggttgcagcctccaatccgcactgaggccggctttcgggattggctccaggttgccctgtcgcagcccgctgtaccggccattgtagcacgtgtgtagccctggacgtaaggaccatgatgacttgacgtcgtccccaccttcctccgg

SEQ ID NO: 2004 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
gaggcctgggaacgtattcaccgcggcatgctgatccgcgattactagcgattccgccttcatgctctcgagttgcagagaacaatccgaactgagacggcttttggagattagctcactctcgcgagtttgctgcccactgtcaccgccattgtagcacgtgtgtagcccagcctgtaagggccatgaggacttgacgtcatccccaccttcctccggc

SEQ ID NO: 2005 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggccggaacgtattcccgcagcaagtgctgatctgcgattactagcaactccgacttcatggggtcgagttgcagaccccaatccgaactgagacaggctttttgagattcgctccacctcacggtatcgcagctcattgtacctgccattgtagcacgtgtgcagcccaagacataaggggcatgatgacttgacgtcgtccccaccttcctccgag

SEQ ID NO: 2006 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggaggtttttgggattagctcctatcactaagtggcagccctttgtcctccccattgtagcacgtgtgtagccctgggcataaaggccatgatgacttgacatcatcccctcttcctcgcgt

SEQ ID NO: 2007 - DNA, 220 bp, Unknown
  Description of Unknown: 16S RNA Operational Taxonomic Unit polynucleotide
  Phylum: WS3; Class: PRR-12; Order: Sediment-1; Family: PRR-10
aaggcccgggaacgtattcaccgctgcctgctgatcagcgattactagcgattccgacttcatgcagtcgagttgcagactgcaatccgaactgagaccggtttttgggagttgcctccacctcgcggtatcggaaccctctgtaccggccattgtagcacgtgtgtagccccagacgtaagggccatgaggacttgacgtcatccccacccttcctccg

SEQ ID NO: 2008 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aagacccgggaacgtattcaccgcggcatgctgatccgcgattactagcgattccgccttcatgctctcgagttgcagagaacaatccgaactgagacaagttttggagattagctcaccgtcgccggttcgctgcccactgtacttgccattgtagcacgtgtgtagcccaacgcgtaagggccatgaggacttgacgtcatccccacttcctccggct

SEQ ID NO: 2009 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcaagctgatccgcgattactagcgattccgacttcatgcagtcgagttgcagactgcaatccggactacgatcggttttctgggattagctccccctcgcggttggcagcctctgtaccgaccattgtatgacgtgtgtagcctacccataagggccatgaggacttgacgtcatccccaccttcctccggttt

SEQ ID NO: 2010 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccggcttcatgcaggcgagttgcagcctgcaatccgaactgagagtggttttatgggattggctcagcctcgcggcttcgcgaccctttgtaccacccattgtagcacgtgtgtagcccaggtcataaggggcatgatgatttgacgtcatccccaccttcctccgg

SEQ ID NO: 2011 - DNA, 220 bp, Unknown
  Description of Unknown: 16S RNA Operational Taxonomic Unit polynucleotide
  Phylum: Proteobacteria; Class: Betaproteobacteria
aagactcgggaacgtattcaccgcgacatgctgatccgcgattactagcgattccgacttcatgcagtcgagttgcagactgcaatccggactacgacgcgctttgagggattggctccaggtcgccccttggcaaccctctgtacgcgccattgtattacgtgtgaagccctacccataagggccatgaggacttgacgtcatccccaccttcctccgg

SEQ ID NO: 2012 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccagcttcatgtcggcgagttgcagccgacaatctgaactgagcccggttttttgggatttgctccacctgacggtctagcttccctttgtgccgggcattgtagtacgtgtgcagccctggccgtaagggccatcctgacttgacgtcatccccaccttcctccg

SEQ ID NO: 2013 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggccggaacgtatccaccgcggcgtgctgatccgcgattactagcgattccaacttcatgcaggcgagttgcagcctgcaatccgaactgagaccgactttatccgattagctccaccttgcggtatcgcgacggtttgtgtcggccattgtagcacgtgtgtggccccagacataaaggccatgcggacttgacgtcatccccaccttcctccggtt

SEQ ID NO: 2014 - DNA, 220 bp, Unknown
  Description of Unknown: 16S RNA Operational Taxonomic Unit polynucleotide
  Phylum: Acidobacteria; Class: Chloracidobacteria
aaggcccgggaacgtattcaccgcaacatgctgatttgcgattactagcgattccaacttcatggagtcgagttgcagactccaatccgaactgagaatggttttcgcgattagctcccccttgcgggattgcgacgttttgtaccatccattgtagcacgtgtgtagccctaagcataaaggccatgatgacttgacatcatccccaccttcctccgtt

SEQ ID NO: 2015 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagacggtttttgggtagttggctccttatcgctaagtggcagccctttgtccgtcccattgtagcacgtgtgtagccctgggcataaaggccatgatgacctgacatcatcccccttccttcc

SEQ ID NO: 2016 - DNA, 220 bp, Unknown
  Description of Unknown: 16S RNA Operational Taxonomic Unit polynucleotide
  Phylum: Proteobacteria; Class: Gammaproteobacteria; Order: Enterobacteriales; Family: Enterobacteriaceae
aaggcccggaacgtatcgaccgtaggcattctgatctacgattactagcgattccgacttcacggagtcgagttgcagactccgatccggactacgacgcactttatgaggtccgcttgctctcgcgaggtcgcttctctttgtatgcgccattgtagcacgtgtgtagccctactcgtaagggccatgatgacttgacgtcatccccaccttcctccag

SEQ ID NO: 2017 - DNA, 220 bp, Unknown
  Description of Unknown: 16S RNA Operational Taxonomic Unit polynucleotide
aagacctgggaacgtattcaccgcggcgtgctgatccgcgattactagcgattccaacttcatgtagtcgagttgcagactacaatccgaactgagaacggttttttccgattggctccccctcgcggttgcaacgtttgtaccgtccattgtagcacgtgtgtagcccctggacataaaggccatgatgacttgacgtcatccccaccttctccggtta

SEQ ID NO: 2018 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccggacgtattcaccgcagcgtgctgatctgcgattactagcgattccaacttcatgtgctcgagttgcagagcacaatccgaactgagacggctttttgagatttgcgcaggattgctccattgcatcccactgtcaccgccattgtagcacgtgtgtagcccagcctgtaagggccatgaggacttgacgtcatccccacttctcgcggctta

SEQ ID NO: 2019 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccaacttcatgccctcgagttgcagaggacaatccgaactgagacgacttttagggatttaccctctgtagtcgccattgtagcacgtgtgtagcccaccccgtaagggccatgaggacttgacgtcatccccacttcctcggcttagcaccggcagtcctgttaga

SEQ ID NO: 2020 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatgcaggcgagttgcagcctgcaatccgaactgagagaaggttttgagattagcatcctgtcaccaggtagcagccctttgtccttcccattgtagcacgtgtgtagccctgggcataaaggccatgatgacttgacatcatcccctccttcctcgcg

SEQ ID NO: 2021 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagaaggttttgggattggctccttatcgctaagtggcagccctttgtccttcccattgtagcacgtgtgtagccctgggcataaaggccatgatgacttgacatcatcccctcctcacgtcgt

SEQ ID NO: 2022 - DNA, 220 bp, Unknown
  Description of Unknown: 16S RNA Operational Taxonomic Unit polynucleotide
  Phylum: Actinobacteria; Class: Actinobacteria; Order: MC47
aagacccgggaacgtattcaccgcggcattgctgatccgcgattactagcaactccgccttcatgaaggcgagtttcagccttcaatccgaaccgggaccggctttttgggattcgctccccctcacgggtttgcagccctttgtaccggccaatgtagcacgtgtgtagcccagaacataaggggcatgatgacttgacgtcatccccacctcctccgg

SEQ ID NO: 2023 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatggagtcgagttgcagactccaatctgaactgagaagtggttttggattagcttccacatcactgtgttgcagccctttgtccactccattgtagcacgtgtgtagccctgggcataaaggccatgatgacttgacatcatcccctccttcctcacg

SEQ ID NO: 2024 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggccggacgaatcgactgcagtatgctgacctgcaattactagcgattcctccttcacgcaggcgagttgcagcctgcgatctgaactgagctccggtttacgggatttgcttgcattcgcatgcttgctgccctctgtccggagcattgtagtacgtgtgtagcccaaggcgtaaggggcatgctgacttgacgtcatccccacttcctccggtttg

SEQ ID NO: 2025 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcgacatggctgattcgcgattactagcgattccgacttcacgcagtcgagttgcagactgcgatccggactacgaccggctttatgggattggctcccctcgcgggttggcaaccctttgtaccggccattgtagcacgtgtgtagccctggtcataagggccatgatgacttgacgtcatccccacttcctcccgg

SEQ ID NO: 2026 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aaggcccgggaacgtattcaccgcagcgatgctgatctgcgattactagcgattccgacttcatggagtcgagttgcagactccaatccggactacgataagttttctgggattagctccctctcgcgagttggcttccctctgtacttaccattgtagcacgtgtgtagccctggtcataaaggccatgatgacttgacgtcatcccccttcctccggt

SEQ ID NO: 2027 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgttctgatccacgattactagcgattccgccttcatgcactcgagttgcagagtgcaatccgaactgagacggctttttaggattagctccccctcgcggttcgctgcctttgtcaccgccattgtagcacgtgtgtagcccagcccgtaagggccatgaggacttgacgtcatccccaccttcctctcggct

SEQ ID NO: 2028 - DNA, 220 bp, Unknown
  Description of Unknown: 16S RNA Operational Taxonomic Unit polynucleotide
  Phylum: Chloroflexi; Class: Chloroflexi; Order: Roseiflexales; Family: Kouleothrixaceae
aaggcccggtacgtattcgaccgcgccatggctgatacgcggttactagcaactccgccttcatgggggcgagttgcagcccccaatctgcactgggttcgtccttggcgattcgcatccgtttgcacggtagctgcgcgttgcgacgaacattgtagcgtgtgtgtcgccccaggcgtaagagccatgcggacttgacgtcatccccgccttcctcccc

SEQ ID NO: 2029 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccggaacgtattcaccgcgccatgctgatgcgcgattactagcgattccaacttcatgcaggcgagttgcagcctgcaatccgaactgagacgtactttgtgattggctcactgtcaccagcttgcaacactctgtatacgccattgtagcacgtgtgtagccctgggcgtaagggccatgatgacttgacgtcatcccctccttcctctctgct

SEQ ID NO: 2030 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgcactcgagttgcagagtgcaatccgaactgagacgacttttggagattagctcaccctcgcgagattgctgcccactgtagtcgccattgtagcacgtgtgtagcccagcgcgtaagggccatgaggacttgacgtcatccccacttctcgccatc

SEQ ID NO: 2031 - DNA, 220 bp, Unknown
  Description of Unknown: 16S RNA Operational Taxonomic Unit polynucleotide
  Phylum: Acidobacteria; Class: Acidobacteria-5
aaggcccgggaacgtattcaccgctgcttgctgatcagcgattactagcgattccagcttcatggagtcgagttgcagactccaatccgaactgagatggttttttgagattggctccccctcgcgggtttgcgactctttgtgccaaccattgtagtacgtgtgtagcctggacataaaggccatgaggacttgacgtcatccccaccttcctccggtt

SEQ ID NO: 2032 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccggcttcatgtcgtcgagttgcagacgacaatctgaactgggcatggttttatgggatttgctccacctgacggtctagcttccctttgtgccatgcattgtagtacgtgtgcacgccctggaccggaaaggccatactgacttgacgtcatccccacttcctcc

SEQ ID NO: 2033 - DNA, 220 bp, Unknown
  Description of Unknown: 16S RNA Operational Taxonomic Unit polynucleotide
aagtctagtaacatattcaccgcagcatgctgttctgcgattactagcgattccagcttcatatgggcgatttcagcccataatccgaactaagataatttttaaagatttgctccaattttaaatcattattgcctctcattgtaattatcattgtagcacgtgtgtagcccaactcataagggccatgaagacttgacgtcatcctaccttccttcac

SEQ ID NO: 2034 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagggtcccgggaacgtattcaccgtatcattgctgatatacgattactagcgattccagcttcacgcagtcgagttgcagactgcgatctgaactgagaaagagtttttgagattagcgccttgtcaccaagtggcagctctttgtctcttccattgtagcacgtgtgtagccctgggcataaaggccatgatgacttgacatcatcccctcttcctcg

SEQ ID NO: 2035 - DNA, 220 bp, Unknown
  Description of Unknown: 16S RNA Operational Taxonomic Unit polynucleotide
  Phylum: Cyanobacteria; Class: S15B-MN24
aaggcctgggaacgtattcaccgtagcgtgctgatccacggttactagcgattccaacttcatgcaggcgagttgcagcctgcaatccgaactgagacatagtttatgggattcgctcactatcgctagcttgcagccctttgtctatgccattgtaggacgtgtgtagcccaagacgtaaggggcatgatgacttgacgtcgtcctcaccttcctccgg

SEQ ID NO: 2036 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcaacattgctgatttgcgattactagcgattccaacttcatgcaggcgagttgcagcctgcaatccgaactgagacattactttttgtgattggcttcctgtcaccaggtcgcaacactttgtatatgccattgtagcacgtgtgtagccctggacgtaagggccatgatgacttgaccgtcgtcccccttcctctc

SEQ ID NO: 2037 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcattgctgatctacgattactagcgattccagcttcatgaggtcgagttgcagacctcaattcgaactgagacagatttttgagattagcatcctgttaccaggtagcaaccctttgtatctgccattgtagcacgtgtgtagccctgggcataaaggccatgatgacttgacatcatcccctctctcacgcct

SEQ ID NO: 2038 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Phyllobacteriaceae
aacggcccgggaacgtattcaccgtggcacgctgatccacgattactagcgattccgacttcatgctctcgagttgcagagaacaatccgaactgagacggctttttgggattagctcctcctcgcggagtggctgcccattgtcaccgccattgtagcacgtgtgtagcccagcccgtaagggccatgatgacttgacgtcatccccacttcctccggc

SEQ ID NO: 2039 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggacgtattcgaccgcagcaatgctgatctgcgattactagcaactccgacttcatggggtcgagttgcagaccccaatccgaactgagacaggcttttgtagattcgctccaccttacggtatcgcagctcattgtacctgccattgtagcacgtgtgcagcccaagacataaggggcatgatgacttgacgtcgtccccaccttcctccg

SEQ ID NO: 2040 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggccgggaacgtattcaccgtggcgatgctgatccacgattactagcgattccagcttcatgccgtcgagttgcagacgacaatccgaactgaggatcggtttgggattgccttggcattgctgcctcggcccccactgtccgacccattgtagcacgtgtgtagccctagacgtaaggaccatgatgacttgacgtcgtccccacttctccggtttg

SEQ ID NO: 2041 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggacgtattcaccgcggcatgctgatccgcgattactagcgattccaacttcatgcactcgagttgcagagtgcaatccgaactgagacggctttttgagatcggctcaggctcgcgcccttgctccccattgtcaccgccattgtagcacgtgtgtagcccaacccgtaagggccatgaggacttgacgtcatccccgccttcctccggct

SEQ ID NO: 2042 - DNA, 220 bp, Unknown
  Description of Unknown: 16S RNA Operational Taxonomic Unit polynucleotide
  Phylum: Proteobacteria; Class: Deltaproteobacteria; Order: Syntrophobacterales; Family: Syntrophobacteraceae
aaggcccgggaacgtattcaccgcggcatgctgatccgcgattactagcgattccgccttcatggagtcgagttgcagactccaatccgaactgagagcggctttttgggattggctccccctcgcgggttgcagccctttgtaccgcccattgtagcacgtgtgtagccccggacataagggccatgaggacttgacgtcatccccgccttcctcccgt

SEQ ID NO: 2043 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccggcttcatgcagtcgagttgcagactgcaatccggactacgaccggcttttctggattagctccccctcgcgggttggctgcctctgtaccggccattgtattacgtgtgaagccctacccataaagggccatgaggacttgacgtcatcccccaccttcctccg

SEQ ID NO: 2044 - DNA, 220 bp, Unknown
  Description of Unknown: 16S RNA Operational Taxonomic Unit polynucleotide
  Phylum: Nitrospirae; Class: Nitrospira; Order: Nitrospirales; Family: Nitrospiraceae
aaggcccgggaacgtattcaccccggcgtgctgatccgggattactagcgattccgccttcacgaggtcgagttgcagacctcgatctgaactgaggccggttgcgattggctcccctcacgggtttgcagcgctttgtgccggccattgtagcacgtgtgtagccccaggcataaaggccatgctgacttgacgtcatccccacttcctccccgttctc

SEQ ID NO: 2045 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatggaggcgagttgcagcctccaatccgcactgagatcggctttacgggattggcttgctatcgctagctcgcaaccctttgtaccgatcattgtagcacgtgtgtagccctagacgtaaggaccatgatgacttgacgtcgtcccacttctccggtt

SEQ ID NO: 2046 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgcgaagggtcgccccttagcatcccattgtcaccgccattgtagcacgtgtgtagcccagcccgtaagggccatgaggacttgacgtccatcccccacctttcctcg

SEQ ID NO: 2047 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgctctcgagttgcagagaacaatccgaactgagacggcttttggagattagctcaccgtcgccggtttgctgcccactgtcaccgccattgtagcacgtgtgtagcccaagcgtaagggccatgaggacttgacgtcatccccacttcctccggctt

SEQ ID NO: 2048 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccaacttcatgctctcgagttgcagagagcaatccgaactgagacggctttgagatttgcgcaggattgctccattgcatcccattgtcaccgcattgtagcacgtgtgtagcccaacctgtaagggccatgaggacttgacgtcatccccacttcctcgcggctta

SEQ ID NO: 2049 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aaggcccgggaacgtattcaccgcagcgttgctgatctgcgattactagcgactccgacttcatgaggtcgagttgcagacctcaatccgaactgagaccggcttttgggattcgctccaccttacggtattgcagccctttgtaccggccattgtagcatgcgtgaagcccaagacataaggggcatgatgatttgacgtcatccccacttccccgacg

SEQ ID NO: 2050 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgctctcgagttgcagagaacaatccgaactgagacggctttttgggattagctcctcctcgcggagtggctgcccgttgtcaccgccattgtagcacgtgtgtagcccagcgcgtaagggccatgaggacttgacgtcatccccacctcctcccgtc

SEQ ID NO: 2051 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaagaggtttttggggattgggcttcacatcgctgtgttgcagccctttgtcctccccattgtagcacgtgtgtagccctgggcataaaggccatgatgacttgacatcatcccctccttcctc

SEQ ID NO: 2052 - DNA, 220 bp, Unknown
  Description of Unknown: 16S RNA Operational Taxonomic Unit polynucleotide
  Phylum: Acidobacteria; Class: Acidobacteria-5
aaggcccgggaacgtattcaccgctgcttgctgatcagcgattactagcgattccagcttcatggagtcgagttgcagactccaatccgaactgagaacggtttttgagattggctccctttgcaggtttgcgactcattgtgccgcccattgtagtacgtgtgtagccctggacataaaggccatgaggacttgacgtcatcccccttcctccggtttt

SEQ ID NO: 2053 - DNA, 220 bp, Unknown
  Description of Unknown: 16S RNA Operational Taxonomic Unit polynucleotide
  Phylum: Armatimonadetes
aaggcccgggaacgtattcaccgcagttagctgacctgcggttactagcgattccggcttcacgcgggcgagttgcagcccgcgatccgaactgggccggctttgtggatttcgctcctccttgcggatcgcagccctctgtaccggccattgtagcatgtgtgaagccccaggcgtaagggccatgccgacttgacgtcgtccccaccttcctcccgcc

SEQ ID NO: 2054 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Propionibacteriaceae
aaggcccgggaacgtattcaccgcagcgttgctgatctgcgattactagcgactccgacttcatggggtcgagttgcagacccaatccgaactgagactggcttttggattcgcttgaccttgcggtttgcagccctttgtaccagccattgtagcatgcgtgaagccctggacttaaggggcatgatgacttgacgtcatccccacttcctccgagttg

SEQ ID NO: 2055 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Phyllobacteriaceae
aaggccggacgtattcaccgtggcatgctgatccacgattactagcgattccgacttcatgctctcgagttgcagagaacaatccgaactgagacggctttttgggattagctcctcctcgcggagtggctgcccactgtcaccgccattgtagcacgtgtgtagcccagcccgtaagggccatgatgacttgacgtcatccccacttcctccggcttat

SEQ ID NO: 2056 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagattacttttggttagcgccctgtcaccaggtggcagccctttgtagtaaccattgtagcacgtgtgtagccctgggcataaaggccatgatgacttgacatcatcccctccttctcgcgtctt

SEQ ID NO: 2057 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccctcgggttgcagaggacaatccgaactgaggacggttaggggattagctccgccttgcgactttgcgaccctctgtcccgtccattgtagcacgtgtgtagccctggacgtaaggaccatgatgacttgacgtcgtccccacttcctccggtt

SEQ ID NO: 2058 - DNA, 220 bp, Unknown
  Description of Unknown: 16S RNA Operational Taxonomic Unit polynucleotide
  Phylum: Acidobacteria; Class: RB25
aaggcctgggaacgtattcaccgcggcatgctgatccgcgattactagcgattccaccttcatgcactcgagttgcagagtgcaatccgaactgagggcggctttttgggattggctccaccttgcggtctcgcagccctttgtaccgcccattgtagcacgtgtgtagccctggacataaaggccatgatgacttgacgtcatccccaccttcctccgg

SEQ ID NO: 2059 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatgcaggcgagttgcagcctgcaatctgaactgagagaggttttttgagatttggcattcctgtcaccaggtagcagccctttgtaccccccattgtacgcacgtgtgtagccctgggcataaaggccatgatgacttgacatcatcccctccttcct

SEQ ID NO: 2060 - DNA, 220 bp, Unknown
  Description of Unknown: 16S RNA Operational Taxonomic Unit polynucleotide
  Phylum: Chloroflexi; Class: Chloroflexi
aaggcccgggtacgtattcaccgcgccatggctgatacgcggttactagcaactccgccttcacgggggcgagtttcagcccccgatctgcactgggccagcgttttacgatttgcatcctcttgcgaggtagcggcgctctgtcgctggcattgtagcgtgtgtgtcgccccaggcgtaagagccatgcggacttgacgtcatccccgccttcctccgg

SEQ ID NO: 2061 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggtcgttttttgggattggctcccttatcgctaagtggcagcctttgtacgcccattgtagcacgtgtgtagccctgggcataaaggccatgatgacttgaccatccatcccctccttcctc

SEQ ID NO: 2062 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcaacatgctgatttgcgattactagcgattccaacttcatgaagtcgagttgcagacttcaatccgaactgagaccggtttagcgattggctcccccttgcgggattgcgacgttttgtaccggccattgtagcacgtgtgtacgccctgaacataaaggccatgatgacttgacatcactccccaccttcctccgg

SEQ ID NO: 2063 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
gaggtccgggaacgtattcaccgtatcattgctgatatacgattactagcgattccagcttcatggagtcgagttgcagactccaatctgaactgagagacgttttttgggattggcttcatatcgctatgttgcagccctttgtacgccccattgtagcacgtgtgtagccctgggcataaaggccatgatgacttgacatcatcccctccttcctcac

SEQ ID NO: 2064 - DNA, 220 bp, Unknown
  Description of Unknown: 16S RNA Operational Taxonomic Unit polynucleotide
  Phylum: Proteobacteria; Class: Deltaproteobacteria; Order: Desulfuromonadales; Family: Geobacteraceae
aaggcccgggaacgtattcaccgcggcatgctgatccgcgattactagcgattccaacttcatggagtcgagttgcagactccaatccgaactgagaccggctttatgagattagcttgacctcgcggtttcgcaactctttgtaccggccattgtagcacgtgtgtagccctggacataagggccatgaggacttgacgtcatccccaccttcctccgt

SEQ ID NO: 2065 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgtagaccggctttggtaggattagctccgcctcgcggcttcgcgacccgttgtaccggccattgtagtacgtgtgtagcccagggtcataaggggcatgatgatttgacgtcatcccccgccttcct

SEQ ID NO: 2066 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
aaggcccggaacgtattcaccgcgccatggctgatgcgcgattactagcgattccagcttcatagagtcgagttgcagactccaatccgaactgagaccggctttcgagatttgcatcacatcgctgtgtagctgccctctgtaccggccattgtattacgtgtgtggcccaaggcgtaagggccgtgatgatttgacgtcatccccactcctctctact

SEQ ID NO: 2067 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccggaacgtattcaccgtggcgtagctgatccacgattactagcgattccagcttcatggaggcgagttgcagcctccaatccgcactgaggtcggctttatgggattggcttgctatcgctagctcgcaaccctttgtaccggccattgtagcacgtgtgtagccctagacgtaaggaccatgatgacttgacgtcgtccccacttcctccggt

SEQ ID NO: 2068 - DNA, 220 bp, Unknown
  Description of Unknown: 16S RNA Operational Taxonomic Unit polynucleotide
  Phylum: Chloroflexi; Class: Chloroflexi; Order: Roseiflexales; Family: Kouleothrixaceae
aaggcccgggtacgtattcaccgcgccatggctgatacgcggttactagcaactccgccttcatgggggcgagttgcagcccccaatctgcactgggtccgtccttggcgattcgcatctccttgcggagtagctgcgcgttgcgacggacattgtagcgtgtgtgtcgccccaggcgtaagagccatgcggacttgacgtcatcccgcttctccccaag

SEQ ID NO: 2069 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
gaggcccgggaacgtattcaccgtggcgtagctgatccacgattactagcgattccagcttcatggaggcgagttgcagcctccaatccgcactgaggccggctttggggattggctcatgcttgcgcatttgcgacccgctgtaccggccattgtagcacgtgtgtagccctagacgtaaggaccatgatgacttgacgtcgtccccacttcctccggt

SEQ ID NO: 2070 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Mycobacteriaceae
aaggcccgggaacgtattcaccgcagcgttgctgatctgcgattactagcgactccgacttcatggggtcgagttgcagaccccaatccgaactgagaccggctttcaagggattcgctccacctcgcggattcgcagccctttgtaccggccattgtagcatgtgtgaagccctggacataaggggcatgatgacttgacgtcatcccccttcctccga

SEQ ID NO: 2071 - DNA, 220 bp, Unknown
  Description of Unknown: 16S RNA Operational Taxonomic Unit polynucleotide
  Phylum: Proteobacteria; Class: Alphaproteobacteria
aaggcctgggaacgtattcaccgcagcctgctgttctgcgattactagcgattccaccttcatgcactcgagttgcagagtgcaatctgaactggggcggctttttgggattagcttactctcgcgagctagctgcccactgtcaccgccattgtagcacgtgtgtagcccagggtgtaagggccatgaggacttgacgtcatccccaccttcctccggc

SEQ ID NO: 2072 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgcagcattgctgatctgcgattactagcgattccagcttcatgcaggcgagttgcagcctgcaatctgaactgagagagggtttttgggagttggcgccttatcgctaagtggctgccctttgtccctcccattgtagcacgtgtgtagccccgggcgactaaagaccatgatgacttgacatcatcccctccttcct

SEQ ID NO: 2073 - DNA, 220 bp, Unknown
  Description of Unknown: 16S RNA Operational Taxonomic Unit polynucleotide
  Phylum: Actinobacteria; Class: Actinobacteria; Order: Solirubrobacterales
aaggtccgggaacgtattcaccgcggcgttgctgatccgcgattactagcaactccaccttcatggaggcgaatttcagcctccaatccgaaccgagaccaactttttgggattcgctccacctcgcggtatcgcaaccctctgtaccggccaatgtagcacgtgtgtagccctggacataaggggcatgatgacttgacgtcatccccaccttcctccg

SEQ ID NO: 2074 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcggcgttctgatccgcgattactagcgattccagcttcatggagtcgagttgcagactccaatccggactgaggatggctttttccgattagctcccttcacaggtttgcgacggtttgtaccacccattgtagcacgtgtgtagccctggacataaaggccatgaggacttgacgtcatccccacttcctccccgt

SEQ ID NO: 2075 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccggacgtattcaccgtatcattgctgatatacgattactagcgattccagcttcatggagtcgagttgcagactccaatctgaactgagaggcgttttgggattagcttcacgtcgccgtgttgcagccctttgtacgccccattgtagcacgtgtgtagccctgggcataaaggccatgatgacttgacatcatcccctccttcctcacgtct

SEQ ID NO: 2076 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccgacttcatggggtcgagttgcagacccaatccgaactgagacggcttttgtgattagctcccattgctgggtggctgccactgtcaccgccattgtagcacgtgtgtagcccagcccgtaagggccatgatgacttgacgtcatccccaccttcctccggcttat

SEQ ID NO: 2077 - DNA, 220 bp, Unknown
  Description of Unknown: 16S RNA Operational Taxonomic Unit polynucleotide
  Phylum: Acidobacteria; Class: PAUC37f
aaggcccgggaacgtattcaccgcggcatgctgatccgcgattactagcgattccagcttcatgcagtcgagttgcagactgcaatccgaactgagaacggttttgggattggctcccctcgcgggtttgcaaccctttgtaccgcccattgtagcacgtgtgtagccctggacataaaggccatgaggacttgacgtcatccccacttcctccggctta

SEQ ID NO: 2078 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcatgctgatccgcgattactagcgattccgacttcatgcaggcgagttgcagcctacaatccgaactgagaccggctttttccgattagctccccctcgcgggctcgcgacggtttgtaccggccattgtagcacgtgtgtagccctggacataaaggccatgctgacttgacgtcatccccacttcctccccg

SEQ ID NO: 2079 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccaacttcatgcactcgagttgcagagtgcaatccgaactggagtacgactttttagggattggctcccctcgcgggattgcagccctctgtagtcgccattgtagcacgtgtgtagcccaccttgtaagggccatgaggacttgacgtcatccccacccttcctcc

SEQ ID NO: 2080 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcggcaatgctgatccgcgattactagcgattccgacttcacgaagtcgagttgcagacttcgatccggactaagatggggtttctggttggctccggctcgcgccttggcgaccctctgtcccaccattgtagtacgtgtgtagccctggtcgtaagggccatgatgacttgacgtcatccccaccttcctccggtt

SEQ ID NO: 2081 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
gaggtccgggaacgtattcaccgtatcattgctgatatacgattactagcgattccagcttcatgaggtcgagttgcagacctcaatccgaactgagatagagtttttgagattagcagcttgttaccaagtagcagccctttgtctctaccattgtagcacgtgtgtagccctgggcataaaggccatgatgacttgacatcatcccctccttcctcgc

SEQ ID NO: 2082 - DNA, 220 bp, Unknown
  Description of Unknown: 16S RNA Operational Taxonomic Unit polynucleotide
  Phylum: Acidobacteria
aaggcccgggaacgtattcaccgcagcgtgctgatctgcgattactagcgattccagcttcacggagtcgagttgcagactccgatccggactgggccggctttttccgattggctcccctcacgggtttgcgacggtttgtaccgaccattgtagcacgtgtgtagccctggacataaaggccatgaggacttgacgtcatcccccttcctccccttat

SEQ ID NO: 2083 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcgttgctgatctgcgattactagcgactccgacttcatggggtcgagttgcagaccccaatccgaactgagaccggcttttgggattcgctccacctcacggtatcgcagctcattgtacctgccattgtagcacgtgtgcagcccaagacataaggggcatgatgacttgacgtcgtccccaccttcctccga

SEQ ID NO: 2084 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Thermomonosporaceae
aaggcccgggaacgtattcaccgcagcgttgctgatctgcgattactagcgactccgacttcatggggtcgagttgcagaccccaatccgaactgagaccggctttccgggattcgctccacctcacggtttcgcagccctttgtaccggccattgtagcatgtttgcagcccaagacataaggggcatgatgacttgacgtcatcccccttcctccggt

SEQ ID NO: 2085 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccagcttcatgccgtcgagttgcagacgacaatctgaactgggcccggttttggggatttgcttccatcttacgatcttgcttccctctgtgccgggcattgtagtacgtgtgcagccctggccgtaagggccatcctgacttgacgtcatccccacctttcctcc

SEQ ID NO: 2086 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Haliangiaceae
aaggcccgggaacgtattcaccgcggcatgctgatccgcgattactagcgattccgacttcatgcagtcgagttgcagactgcaatccgaactgggaccggttttttgagattggcgtgcctttgcaggttagcaaccctttgtaccggccattgtagtacgtgtgtagccctgggcataagggccatgaggacttgacgtcatccccaccttcctccga

SEQ ID NO: 2087 - DNA, 220 bp, Unknown
  Description of Unknown: 16S RNA Operational Taxonomic Unit polynucleotide
  Phylum: Verrucomicrobia; Class: Opitutae; Order: Opitutales; Family: Opitutaceae
aaggcccgggaacgtattcacggcgtcgtagctgatacgccattactagcgattccggcttcatgcagtcgagttgcagactgcaatctgaactgggctcggtttggatttgctcacctcgcggtcttgcgtcctctgtaccgagcattgtagcacgtgtgcagcccaggccgtaagggccatcctgacttgacgtcatccccacttcccaccctcagag

SEQ ID NO: 2088 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcatcgttctgatacgccattactagcgattccagcttcacgcaggcgagttgcagcctgcgatccgaactgaggacggttttttgcggattggcttcccctcgcgggttcgcagcgcattgtaccgcccattgtagcacgtgtgtagccctggacataaaggccatgatgacttgacatcatccccacttcctccaa

SEQ ID NO: 2089 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccggcttcatgccgtcgagttgcagacgacaatctgaactgggcccggttttctggtttgctccacctgacggtcttgcttccctctgtaccgggcattgtagtacgtgtgcagccctggccgtaagggccatactgacttgacgtcatccccacttcctcccgat

SEQ ID NO: 2090 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcagcaatgctgatctgcgattactagcgattccgacttcatggagtcgagttgcagactccaatccggactacgacagattttctgggattagctccccgtcgccgtggctccctctgtatctgccattgtagcacgtgtgtagccctggtcataaaggccatgatgacttgacgtcatccccaccttcctccggtt

SEQ ID NO: 2091 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aagggcccgggaacgtattcaccgtggcgtagctgatccacgattactagcgattccagcttcatggaggcgagttgcagcctccaatccgcactgaggccggctttgaggattggctcacgcttgcgcgcttgcgacccgctgtaccggccattgtagcacgtgtgtagccctagacgtaaggaccatgatgacttgacgtcgtccccaccttcctccg

SEQ ID NO: 2092 - DNA, 220 bp, Unknown
  Description of Unknown: 16S RNA Operational Taxonomic Unit polynucleotide
  Phylum: Armatimonadetes; Class: Armatimonadia; Order: Armatimonadales; Family: Armatimonadaceae
acaaggcccgggaacgtattcaccgcagtttcgctgacctgcggttactagcgattccagcttcatgcaggcgagttgcagcctgcaatccgaactgagatgcctttttgagattcgctcaccctcgcggggtcgctcccctttgtaggcaccattgtagcatgtgtgaagccccaggcgtaagggccatgccgacttcgacgtcatccccgcttcctcc

SEQ ID NO: 2093 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Moraxellaceae
aaggcccgggaacgtattcaccgcggcattctgatccgcgattactagcgattccgacttcatggagtcgagttgcagactccaatccggactacgatcggctttttgagattagcatcctatcgctagtagcaacccctttgtaccgaccattgtagcacgtgtgtagccctgggtcggtaaggggccatgatgacttgacgtcgtccccgccttcctc

SEQ ID NO: 2094 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccggaacgtattcaccgcagcaatgctgatctgcgattactagcgattccgacttcatggagtcgagttgcagactccaatccggactgagatagggtttctgggattggcttgccctcgcgggtttgcagccctctgtccctaccattgtagtacgtgtgtagccctggccgtaagggccatgatgacttgacgtcatcccccttcctccggtg

SEQ ID NO: 2095 - DNA, 220 bp, Unknown
  Description of Unknown: 16S RNA Operational Taxonomic Unit polynucleotide
  Phylum: Proteobacteria; Class: Betaproteobacteria
aaggcccgggaacgtattcaccgcgacatgctgatccgcgattactagcgattccgacttcatgctctcgagttgcagagaacaatccggactacgaccggctttctgggattggctcccctcgcgggttggcaaccctctgtaccgaccattgtatgacgtgtgaagccctacccataagggccatgaggacttgacgtcatccccaccttcctccggc

SEQ ID NO: 2096 - DNA, 220 bp, Unknown
  Description of Unknown: 16S RNA Operational Taxonomic Unit polynucleotide
  Phylum: Acidobacteria; Class: Chloracidobacteria
aaggcccgggaacgtattcaccgcggcgttctgatccgcgattactagcgattccagcttcatgaagtcgagttgcagacttcaatccgaactgagaccggtttttgcgattaactccccctcgcgggatcgtaacgtttgtaccggccattgtagcacgtgtgtagccctaagcataaaggccatgatgacttgacatcatccccaccttcctccgttt

SEQ ID NO: 2097 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggcccgggaacgtattcacccctgccatgctgatcagggattactagcgattccgccttcatggagtcgagttgcagactccaatccgtactgaggtcggttttttggttggctccacctcgcggcttcgcagccctttgtaccgaccattgtagcacgtgtgtagccctggacataggggccatgaggacttgacgtcatccccaccttcctccgac

SEQ ID NO: 2098 - DNA, 220 bp, Unknown
  Description of Unknown: 16S RNA Operational Taxonomic Unit polynucleotide
  Phylum: Acidobacteria; Class: Chloracidobacteria
gagacccgggaacgtattcaccgcggcgtgctgatccgcgattactagcgattccaacttcatggagtcgagttgcagactccaatccgaactgagaccggctttttccgattggctccctctcgcgagttcgcagcggtttgtaccggccattgtagcacgtgtgtagccctggacatagaggccatgatgacttgacgtcatccccaccttcctccgg

SEQ ID NO: 2099 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aaggcccgggaacgtattcaccgtggcgttgctgatccacattactagcgactccgacttcatgaggtcgagttgcagacctcaatccgaactgagaccggctttttgggattcgctccaccttacggtattgcagccctttgtaccggccattgtagcatgcgtgaagcccaagacataaggggcatgatgatttgacgtcatccccactcctccgagt

SEQ ID NO: 2100 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Cystobacteraceae
aaggcccgggaacgtattcaccgcggcgtgctgatccgcgattactagcgattccgccttcatggagtcgagttgcagactccaatctgaactgagaccggttttatgcgattagctccccctcgcgggttggcgacgcgttgtaccggccattgtagcacgtgtgtagccctggtcataaaggccatgaggacttgacgtcatcccacctccttcctct

SEQ ID NO: 2101 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aaggacccgggaacgtattcaccgcagcaatgctgatctgcgattactagcgattccgacttcatggagtcgagttgcagactccaatccggactacgataagttttctgggattagctcccgctcgcgcgttggcttccctctgtacttaccattgtagcacgtgtgtagccctggtcataaaggccatgatgacttgacgtcatccccaccttcctcc

SEQ ID NO: 2102 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaaagggttttgagattagcgccttgttgccaagtggcagctctttgtcccttccattgtagcacgtgtgtagccctgggcataaaggccatgatgacttgaccatccaatcccctccttcctc

SEQ ID NO: 2103 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgtttttgggatttaggccttcacatcactgtgttgcagccctttgtacgccccattgtagcacgtgtgtagccctgggcataaaggccatgatgacttgacatcatcccctccttcctc

SEQ ID NO: 2104 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccggcttcatgtaggcgagttgcagcctacaatccgaactgagaatggtttttatgggtattggctcgacctcgcggctttgctgccctttgtaccatccattgtagcacgtgtgtagcccaggtcataaggggcatgatgatttgacgtcatccccaccttcctcc

SEQ ID NO: 2105 - DNA, 220 bp, Unknown
  Description of Unknown: 16S RNA Operational Taxonomic Unit polynucleotide
  Phylum: Proteobacteria; Class: Deltaproteobacteria
aaggcccgggaacgtattcaccccggcgtgctgatccgggattactagcgattccaacttcatggagtcgagttgcagactccaatctgaactgaggcaggtttttgagattggcttcaacttgcgttgtcgcaaccctttgtaccggccattgtagcacgtgtgtagccctgggcataagggccatgaggacttgacgtcatccccaccttctccgact

SEQ ID NO: 2106 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccagcttcacgcagtcgagttgcagactgcgatccggactacgatcggttttctgggattggctccgcctcgcggcttggcaaccctctgtacccaccattgtatgacgtgtgaagccctacccataagggccatgaggacttgacgtcatcccaccttcctccggt

SEQ ID NO: 2107 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatggagtcgagttgcagactccaatctgaactgagaagtggttttgggagttagcttcacatcactatgttgcagccctttcgttccactccattgtagcacgtgtgtagccctgggcgataaaggccatgatgacttgacatcatcccctccttcct

SEQ ID NO: 2108 - DNA, 220 bp, Unknown
  Description of Unknown: 16S RNA Operational Taxonomic Unit polynucleotide
  Phylum: Acidobacteria; Class: iii1-8; Order: 32-20
aaggcccgggaacgtattcaccgcggcgtgctgatccgcgattactagcgattccagcttcatggggtcgagttgcagaccccaatccgaactgagaccggcttttagcgatttgctcgacttgcgttttcgcgacgctctgtaccggccattgtagcacgtgtgtagccctggacataaaggccatgaggacttgacgtcatccccaccttcctccggt

SEQ ID NO: 2109 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgagaccggcttttttaggattagctccacctcgcggcttcgcagcccgttgtaccggccattgtagtacgtgtgtagcccaggtcataaggggcatgatgatttgacgtcatccccaccttcctccg

SEQ ID NO: 2110 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcaattccgacttcatgcaccccgacgttgcagagtgcaatccgaactgagacggcttttagggattagcatcacatcgctgtgtagcaaccctctgtcaccgcccattgtagcacgtgtgtagcccagcccgtaagggccatgaagacttgacgtcatccccaccttcctcc

SEQ ID NO: 2111 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgatgctgatccacgattactagcgattccagcttcatgccgtcgagttgcagacgacaatccgaactgaggccggttgggattgcctcggcattgctgcctcggccccctttgtcccagccattgtagcacgtgtgtagccctagacgtaaggaccatgatgacttgacgtcgtcccaccttcctccggtttg

SEQ ID NO: 2112 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagacccgggaacgtatcaccgcgacattctgatccgcgattactagcgattccgacttcacgcagtcgagttgcagactgcgatccggactacgactggctttatgggattggctccccctcgcgggttggcaaccctctgtaccagccattgtatgacgtgtgtagccccacctataagggccatgaggacttgacgtcatccccaccttcctccggt

SEQ ID NO: 2113 - DNA, 220 bp, Unknown
  Description of Unknown: 16S RNA Operational Taxonomic Unit polynucleotide
  Phylum: TM7; Class: TM7-3; Order: EW055
aagatcagtgacgtattcaccgcaatttgctgacttgcgattactagcgattccggcttcaaagaggcgagtttcagcctcttatccgaactgggacaagctttggtgcgatttgctccacatcactgcttcgctgcgcattgtacttgccattgtatcgtgtttctagcccaggcgtaagggtaatactgacctgacatcatccctccttccttcccta

SEQ ID NO: 2114 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcccgggaacgtattcaccgcggcatgctgatccgcgattactagcgattccgccttcatgctctcgagttgcagagaacaatccgaactgagacaacttttggagattagctaccctcgcgaggttgctgcccactgtagttgccattgtagcacgtgtgtagcccagcgcgtaagggccatgaggacttgacgtcatccccacttcctccggctt

SEQ ID NO: 2115 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggcccgggaacgtattcaccgctgccatgctgatcagcgattactagcgattccgacttcaaggagtcgagttgcagactcctatctgtactgaggtcacttttttgagattggctccctctcgcgagttcgctaccctttgtatcgaccattgtagcacgttttgtagccctggacataagggccatgatgacttgacgtcatccccaccttcctcg

SEQ ID NO: 2116 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccgggacacgaccggtttctgggattgggctccccctcgcgggttggcagccctctgtaccggccattgtatgacgtgtgtagccctacccataagggccatgaggacctgacgtcatccccaccttcctccgg

SEQ ID NO: 2117 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggcccgggaacgtattcaccgtatcattgctgatatacgattactagcgattccagcttcatgcaggcgagttgcagcctgcaatctgaactgagaagagttttgggattagctccttatcgctaagtggcagccctttgtactctccattgtagcacgtgtgtagccctgggcataaaggccatgatgacttgacatcatcccctccttctcgcgtc

SEQ ID NO: 2118 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccggaacgtattcggaccgcgagcaatgctgatctgcgattactagcaactccgacttcatggggtcgagttgcagaccccaatccgaactgagacaggcttttttgagattgctccacctcacggtatcgcagctcattgtacctgccattgtagcacgtgtgcagcccaagacataaggggcatgatgacttgacgtcgtccccaccttcctc

SEQ ID NO: 2119 - DNA, 220 bp, Unknown
  Description of Unknown: 16S RNA Operational Taxonomic Unit polynucleotide
  Phylum: Proteobacteria; Class: Betaproteobacteria; Order: Burkholderiales
gagacccgggaacgtattcaccgcgacatgctgatccgcgattactagcgattccgacttcatgcagtcgagttgcagactgcaatccggactacgactggttttctgggattggctcccccttgcgggttggcagccctctgtaccagccattgtatgacgtgtgaagccctacccataagggccatgaggacttgacgtcatccccacttcctccggt

SEQ ID NO: 2120 - DNA, 220 bp, Unknown
  Description of Unknown: 16S RNA Operational Taxonomic Unit polynucleotide
  Phylum: Cyanobacteria; Class: Synechococcophycideae; Order: Synechococcales; Family: Acaryochloridaceae
aaggcccgggaacgtattcaccgcagtatgctgacctgcgattactagcgattccgccttcatgcaggcgagttgcagcctgcaatctgaactgagccatggtttacgagattagcttgtactcgcgcacttgcaactctctgtccatagcattgtagtacgtgtgtagcccaggacgtaaggggcatgctgacttgacgtcatcccactcctccggttt

SEQ ID NO: 2121 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggtccgggaacgtattcaccgcggcattgctgatccgcgattactagcgattccaccttcatgcactcgagttgcagagtgcaatccgaactgggacggctttttgggatcggctccggctcgcaccttcgcatcccactgtcaccgccattgtagcacgtgtgtagcccagcccgtaagggccatgaggacttgacgtcatccccacttcctccggc

SEQ ID NO: 2122 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
agggcccgggaacgtattcaccgcgccatggctgatgcgcgattactagcgattccagcttcatagagtcgagttgcagactccaatccgaactgagaccggctttcgagatttgcatcacatcgctgtgtagctgccctctgtaccggccattgtattacgtgtgtggcccaaggcgtaagggccgtgatgatttgacgtcatccccaccttcctctct

SEQ ID NO: 2123 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
gaggtccgggaacgtattcaccgcgccattgctgatgcgcgattactagcgattccaacttcatgcaggcgagtgcagcctgcaatccgaactgagacgtacttttgtgattggctcgctatcgctagctggcaacactttgtatacgccattgtagcacgtgtgtagccctggacgtaagggccatgatgacctgacgtcatcccctccttcctctccg

SEQ ID NO: 2124 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcgacatgctgatccgcgattactagcgattccgacttcacgcagtcgagttgcagactacgatccggacacgactggtttatgggattagctccccctcgcgggttggcaccctctgtaccagccattgtatgacgtgtgtagccctacccataagggccatgaggacttgacgtcatccccacttcctccggtttg

SEQ ID NO: 2125 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgctctcgagttgcagagaacaatccgaactgagacggttttgggagtttgtctcactctcgcgagtttgtctgcccacctgtcaccgccattgtagcacgtgtgtagcccagcgcgtaagggccatgaggacttgacgtcatccccaccttcctccg

SEQ ID NO: 2126 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
acaaggtccgggaacgtattcaccgcgccattgctgatgcgcgattactagcgattccagcttcatgtagtcgagttgcagactacaatctgaactgagaagaggtttttgagatttgcatcctgtcaccaggtagcgtccctttgtcctccccattgtagcacgtgtgtagccctgggcataaaggccatgatgacctgacatcatcccctccttcctc

SEQ ID NO: 2127 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcgaccgcggcatgctgatccgcgattactagcgattccaacttcatgcactcgagttgcagagtgcaatccgaactgagacgactttttagggattggctccccctcgcgggattgcagccctctgtagtcgccattgtagcacgtgtgtagcccaccttgtaagggccatgaggacttgacgtcatccccacttcccccat

SEQ ID NO: 2128 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggcccgggaacgaattcactgcagtatgctgacctgcaattactagcgattcctccttcacgcaggcgagttgcagcctgcgatctgaactgagctccggtttacgggatttgcttgcattcgcatgcttgctgccctctgtccggagcattgtagtacgtgtgtagcccaaggctaagggcatgctgacttgacgtcatcccacttcctccggtgtc

SEQ ID NO: 2129 - DNA, 220 bp, Unknown
  Description of Unknown: 16S RNA Operational Taxonomic Unit polynucleotide
  Phylum: Proteobacteria; Class: Betaproteobacteria; Order: Rhodocyclales
aagacccgggaacgtattcaccgcgacatgctgatccgcgattactagcgattccgacttcatggagtcgagttgcagactccaatccggactacgacgcactttctgggattggctcccccttgcgggttggcaacctctgtatgcgccattgtatgacgtgtgaagccctacccataagggccatgaggacttgacgtcatccccaccttcctccggt

SEQ ID NO: 2130 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcgaccgcagcgttgctgatctgcgattactagcgactccgacttcatggggtcgagttgcagaccccaatccgaactgagaccggctttttagggatttcgctccacctcacggtttagcagccctctgtaccggccattgtagcatgtttgcagcccaagacataaggggcatgatgacttgacgtcatccccacttcctc

SEQ ID NO: 2131 - DNA, 220 bp, Unknown
  Description of Unknown: 16S RNA Operational Taxonomic Unit polynucleotide
  Phylum: Cyanobacteria; Class: Synechococcophycideae; Order: Pseudanabaenales; Family: Pseudanabaenaceae
aagacccgggaacgtattcaccgcagtatgctgacctgcgattactagcgattccgccttcatgcaggcgagttgcagcctgcaatctgaactgtgcctcggttatgggatttgcttgtcatcgctgacttgctgcccttgtccgaagcattgtagtacgtgtgtagcccagaacgtaaggggcatgctgacttgacgtcatccccacttcctccgagtt

SEQ ID NO: 2132 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatgcaggcgagttgcagcctgcaatctgaactgagattaactttttgggattagctccttatcactaagtggcagtccctttgtagttaccattgtagcacgtgtgtacgccctgggcataaaggccatgatgacttgacatcatcccctccttcctc

SEQ ID NO: 2133 - DNA, 220 bp, Unknown
  Description of Unknown: 16S RNA Operational Taxonomic Unit polynucleotide
  Phylum: Acidobacteria; Class: iii1-8; Order: 32-20
aaggccggaacgtattcgaccgcggcgtgctgatccgcgattactagcgattccagcttcatggggtcgagttgcagaccccaatccgaactgagaccggctttttgcgattgactccagcttgcgctttcgtagcgctttgtaccggccattgtagcacgtgtgtagccctggacataaaggccatgaggacttgacgtcatccccaccttcctccggt

SEQ ID NO: 2134 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccgggtttctgggtattagctccccctcgcgggttggcagccctctgtccccggccattgtatgacgtgtgtagccctaccataagggccatgatgacctgacgtcatccccacttcctcccg

SEQ ID NO: 2135 - DNA, 220 bp, Unknown
  Description of Unknown: 16S RNA Operational Taxonomic Unit polynucleotide
  Phylum: Acidobacteria; Class: Chloracidobacteria
aagaccccgggaacgtattcaccgcagcatgctgatctgcgattactagcgattccagcttcatggagtcgagttgcagactccaatccgaactgagacgagctttttccgattggctcccattgctggtttgcagcggtttgtactcgccattgtagcacgtgtgtagccctggacataaaggccatgaggacttgacgtcatccccaccttcctccgt

SEQ ID NO: 2136 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
gaggcccgggaacgtattcaccgtggcattctgatccacgattactagcgattccaacttcatgcactcgagttgcagagtgcaatccgaactgagacggcttttggagattagctcgacatcgctgcctcgctgcccattgtcaccgccattgtagcacgtgtgtagcccagcccgtaagggccatgaggacttgacgtcatccccaccttcctctcgg

SEQ ID NO: 2137 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcggcgtgctgatccgcgattactagcgattccagcttcatggagtcgagttgcagactccaatccgaactgaggccggcttttcattagctcccttcgcaggtttgcgacggtttgtaccgaccattgtagcacgtgtgtagccctggacataaaggccatgaggacttgacgtcatccccaccttcctccccgtat

SEQ ID NO: 2138 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcattgctgatctacgattactagcgattccagcttcatgaagtcgagttgcagacttcaatctgaactgagaagcgttttttgggattagcttcacatcactgtgttgcagccctttgtacgctccattgtagcacgtgtgtagccctgggcataaaggccatgatgacttgacatcatcccctccttcctcag

SEQ ID NO: 2139 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtctgggaacgtattcaccgtatcattgctgatatacgattactagcgattccagcttcacgcagtcgagttgcagactgcgatccgaactgagagacggtttttgggattggctccttatcgctaagtggcagccctttgtccgtcccattgtagcacgtgtgtagccctgggcataaaggccatgatgacctgacatcatcccctccttcctcgc

SEQ ID NO: 2140 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatctgaactgagaggcgttttggattagcttcacatcactgtgttgcagccctttgtacgccccattgtagcacgtgtgtagccctgggcataaaggccatgatgacttgacatcatcccctctcctcacgtctt

SEQ ID NO: 2141 - DNA, 220 bp, Unknown
  Description of Unknown: 16S RNA Operational Taxonomic Unit polynucleotide
  Phylum: Chloroflexi; Class: TK-SH13
aaggcccgggaacatattcaccgcgctatgctgacacgcggttactagcaactccgacttcatgcactcgggttgcagagtgcaatctgaactgaggccgcctttagagatctgctccccatcgctgggtggcttctcgctgtaacgaccattgtagcgtgtgtgtagccctggacgtaagagccatgctgacttgacatcatccccaccttcctccggt

SEQ ID NO: 2142 - DNA, 220 bp, Unknown
  Description of Unknown: 16S RNA Operational Taxonomic Unit polynucleotide
  Phylum: Verrucomicrobia; Class: Opitutae; Order: Opitutales; Family: Opitutaceae
aaggcccgggaacgtattcacggcgtcgtagctgatacgccattactagcgattccaacttcatgtagtcgagttgcagactacaatctgaactgggcacggtttttggtttgcttcacctcgcggtgttgcgtccctctgtaccgtgcattgtagcacgtgtgcagccctggccgtaagggccatcctgacttgacgtcatcccaccttccaccctcag

SEQ ID NO: 2143 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcattgctgatctacgattactagcgattccagcttcatgaggtcgagttgcagaccccaattcgaactgagacagattttttgtagattagcatcctgttaccaggtagcaaccctttgtatctgccattgtagcacgtgtgtagccctgggcgataaaggccatgatgacttgacatcatcccctccttccct

SEQ ID NO: 2144 - DNA, 220 bp, Unknown
  Description of Unknown: 16S RNA Operational Taxonomic Unit polynucleotide
  Phylum: Nitrospirae; Class: Nitrospira; Order: Nitrospirales; Family: Nitrospiraceae
aaggcccgggaacgtattcaccgcggcgtgctgatccgcgattactagcgattccgccttcatggggtcgagttgcagaccccaatctgaactgaggccggttgtagattagcttccctttgcaggtttgcagctctctgtaccggtcattgtagcacgtgtgtagccccaggcataaaggccatgctgacttgacgtcatccccaccttcctccccgtt

SEQ ID NO: 2145 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgcgaagggtcgccccttagcatcccacttgtcaccgccattgtagcacgtgtgtagcccagcccgtaagggcctgagggacttgacgtcatccccaccttcctcgcg

SEQ ID NO: 2146 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgcagtcgagttgcagactgcaatctgaactgagagcgctttttggagttagtctccttgtcgccaagtggcagccctttcgttagcgcccattgtagcacgtgtgtagccctgggcataaaggccatgatgacttgacatcatcccctccttcctc

SEQ ID NO: 2147 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggaacgtattcaccgcggcgtgctgatccgcgattactagcgattccaacttcatgcacccgagttgcagagtgcaatccgaactgagacggcttttggggattagctccaggtcgccccttcgctcccactgtcaccgccattgtagcacgtgtgtagcccaacccgtaagggccatgaggacttgacgtcatccccgccttcctccggct

SEQ ID NO: 2148 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatctgaactgagaggcgttttgggagttagcttcacatcgctgtgttgcagccctttgtacgcccacttgtagcacgtgtgtagccctgggcataaaggccatgatgacttgacatcatcccctccttcctcacg

SEQ ID NO: 2149 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggacgtattcaccgtggcgtgctgatccacgattactagcgattccgacttcatgcactcgagttgcagagtacaatccgaactgagacggcttttttgagattggcgcagggtcgccccttgcatcccactgtcaccgccattgtagcacgtgtgtagcccagcccgtaagggccatgaggacttgacgtcatccccgccttctccggctt

SEQ ID NO: 2150 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggcccgggaacgaattcgactggcagtatgctgacctgcaattactagcgattcctccttcacgcaggcgagttgcagcctgcgatctgaactgagccacggtttatgagatttgcttgctatcgctagcttgctgccctttgtccgtagcattgtagtacgtgtgtagcccaagacgtaaggggcatgctgacttgacgtcatccccaccttcctcc

SEQ ID NO: 2151 - DNA, 220 bp, Unknown
  Description of Unknown: 16S RNA Operational Taxonomic Unit polynucleotide
  Phylum: Acidobacteria; Class: Acidobacteria; Order: Acidobacteriales; Family: Acidobacteriaceae
aaggtccgggaacgtattcaccgcggcattctgatccgcgattactagcgattccagcttcacgcagtcgagttgcagactgcgatccgaactgaggccggctttttccgattagctccccctcgcgggtttgcgacggtttgtaccggccattgtagcacgtgtgtagccctggacataaaggccatgaggacttgacgtcatccccaccttcctcccc

SEQ ID NO: 2152 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtatgaccgcgagcaatgctgatctgcgattactagcaactccgacttcatggggtcgagttgcagaccccaatccgaactgagacaggctttttgagattcgctcaacctcacggtatcgcagctctttgtacctgccattgtagcacgtgtgcagcccaagacataaggggcatgatgacttgacgtcgtccccaccttcctccg

SEQ ID NO: 2153 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgcagtcgagttgcagactgcaatctgaactgagagaaggttttgggattagctcttgtcgccaagtggcagccctttgtccttcccattgtagcacgtgtgtagccctgggcataaaggccatgatgacttgacatcatcccctccttcctcacgt

SEQ ID NO: 2154 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggcccgggaacgaattcactgcagtatgctgacctgcaattactagcgattcctccttcacgcaggcgagttgcagcctgcgatctgaactgagctacgatttccgggatttgcttgctatcgctagcttgctgccctctgttcgtagcattgtagtacgtgtgtagcccaagacgtaaggggcatgctgacttgacgtcactcccctaccttccgct

SEQ ID NO: 2155 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Brucellaceae
aaggcccgggaacgtattcaccgcggcatgctgatccgcgattactagcgattccaacttcatgcactcgagttgcagagtgcaatccgaactgagatggctttggagattagctcacactcgcgtgctcgctgcccactgtcacaccatttgtagcacggtgtgtagcccagcccgtaagggccatgaggacttgacgtcatccccacttcctctcggc

SEQ ID NO: 2156 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcctgggaacgtattcaccgcagcgtgctgatccgcgattactagcaattccaacttcatgcactcgagttgcagagtgcaatccgaactgagatggcttttagggattagcatgacctcgcggtctagctgccctctgtcaccaccattgtagcacgtgtgtagcccagcccgtaagggccatgaagacttgacgtcatccccaccttcctccggc

SEQ ID NO: 2157 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
aaggcccgggaacgtattcaccgcgtcattgctgatacgcgattactagcgaatccaacttcatggggtcgagttgcagaccccaatccgaactgtgaatggctttgtgagattcgcataccgttgccggctagctgcctctgtaccatccattgtagcacgtgtgtagcccggacgtaagggccatgatgacttgacgtcgtcccctcttcctctctgt

SEQ ID NO: 2158 - DNA, 220 bp, Unknown
  Description of Unknown: 16S RNA Operational Taxonomic Unit polynucleotide
  Phylum: Acidobacteria; Class: Chloracidobacteria
aaggcccgggaacgtattcaccgcggcatgctgatctgcgattactagcgattccagcttcatggagtcgagttgcagactccaatccgaactgagacaagctttttgcgattggctccctttgcaggtttgcagcgctttgtacttgccattgtagcacgtgtgtagccctggacataaaggccatgaggacttgacgtcatccccaccttcctccgtt

SEQ ID NO: 2159 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
gaggcccgggaacgtattcaccgcagcattgctgatctgcgattactagcgaatccaacttcacggggtcgagttgcagaccccgatccgaactgtgaacagctttttgagattggcatcctgttgccaggtagctgcctctgtactgcccattgtagcacgtgtgtagccccggacgtaagggccatgatgacttgacgtcgtccccctccttcctctc

SEQ ID NO: 2160 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobia subdivision 3
aaggcctgggaacgtattcacggcgccgtagctgatgcgccattactagcgattccaacttcatgccgtcgagttgcagacgacaatccgaactggggcccggttttttgggatttgtctccacctgacggtcttgcttccctctgtgccgggcattgtagtacgtgtgcagccctggccgtaagggccatactgacttgacgtcatccccaccttcctc

SEQ ID NO: 2161 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagacccgggaacgtattcaccgtatcattgctgatatacgattactagcgattccagcttcacgcagtcgagttgcagactgcgatctgaactgagagagggtttttgagattggctccttatcgctaagtggcagctctttgtccctcccattgtagcacgtgtgtagccctgggcataaaggccatgatgacttgacatcatcccctccttcctcgc

SEQ ID NO: 2162 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgagaccggctttttaggattcgttccacctcgcggtttcactgccccgttgtaccggccattgtagtacgtgtgtagcccagggtcataagggggcatgatgatttgacgtcatccccaccttcctc

SEQ ID NO: 2163 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aagggcccggggaacgtattcaccgcagcaatgctgatctgcgattactagcaactccgacttcatggggtcgagttgcagaccccaatccgaactgagaccggcttttttgagattcgctccacctcacggtttcgcagctctttgtaccggccattgtagcacgtgtgcagcccaagacataaggggcatgatgacttgacgtcgtccccaccttcct

SEQ ID NO: 2164 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Actinosynnemataceae
aaggcccgggaacgtattcaccgcagcgttgctgatctgcgattactagcgactccgacttcacggggtcgagttgcagaccccgatccgaactgagaccggctttatgggattcgctccacctcacggcttagcagccctttgttaccggcccattgtagcatgtgtgaagccctggacataaggggcgatgatgacttgacgtcatcccaccttcctc

SEQ ID NO: 2165 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggccggaacgaatcggactgcagtatgctgacctgcaattactagcgattcctccttcacgcaggcgagttgcagcctgcgatctgaactgagctccggtttacgggatttgcttgccatcgctggcttgctgccctctgtccggagcattgtagtacgtgtgtagcccaaggcgtaaggggcatgctgacttgacgtcatccccaccttcctccggt

SEQ ID NO: 2166 - DNA, 220 bp, Unknown
  Description of Unknown: 16S RNA Operational Taxonomic Unit polynucleotide
  Phylum: Chlamydiae; Class: Chlamydiae; Order: Chlamydiales; Family: Rhabdochlamydiaceae
aaggcccgggaacgtattcacgacgttgttgctgacacgtcattactagcaattccaacttcatgtagtcgagttgcagactacaatccgaactgggatcggctttacggatttgctccaccttgcggtcttgctgccttctgtaccgaccattgtagcacgtgtgtagccccagatataaaggccatgcggacttgacgtcatcctcaccttctcctgt

SEQ ID NO: 2167 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
aaggcccgggaacgtattcaccgcagcattgctgatctgcgattactagcgaatccaacttcacggggtcgagttgcagaccccgatccgaactgtgaatggcttttggagattggcatcctgttaccaggtagctgccctctgtaccatccattgtagcacgtgtgtagccccggacgtaagggccatgatgacttgacgtcgtcccctccttcctccg

SEQ ID NO: 2168 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagacccgggaacgtattcaccgtgacattctgatccacgattactagcgattccgacttcacgcagtcgagttgcagactgcgatccggactacgactggttttatgggattagctccccctcgcgggttggcaaccctttgtaccagcccattgtatgacgtgtgtagcccccaacctataaggggccatgagacttgacgtcatccccaccttcctc

SEQ ID NO: 2169 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggcccgggaacgtattcaccgcagcgtgctgatctgcgattactagcgattccaacttcatggggtcgagttgcagaccccaatccgaactgagacggctttttgagatttgtcgaagggtcggccccctttcgcatccctctgtcaccgccattgtagcacgtgtgtagcccagcccgtaagggccatgaggacttgacgtcatcccccaccttcct

SEQ ID NO: 2170 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Polyangiaceae
aaggcccgggaacgtattcacccctgcctgctgatcagggattactagcgattccaacttcaaagagtcgagttgcagactcttatccgtactgaggccggttttttcggattggctcccccctcgcgggttagcgaccgtctgtaccgaccattgtagcacgtgtgtagccctggacataagggccatgaggacttgacgtcatccccaccttcctccg

SEQ ID NO: 2171 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccagcttcacgcagtcgagttgcagactgcgatccgaactgagaacagatttatgggattggctaaaccttgcggtcttgcagcccctttgttctgtccattgtagcacgtgtggtagcccaggtcataaggggcatgatgatttgacgtcatccccaccttcctcc

SEQ ID NO: 2172 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagggtcccgggaacgtattcaccgtatcattgctgatatacgattactagcgattccagcttcacgcagtcgagttgcagactgcgatctgaactgagagaaggttttgagattagctccctgtcaccaggtggcagccctttgtccttcccattgtagcacgtgtgtagccctgggcataaaggccatgatgacttgacatcatcccctccttcctcg

SEQ ID NO: 2173 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcgccattgctgatgcgcgattactagcgattccaacttcatgcaggcgagttgcagcctgcaatccgaactgagacgtcctttttgtgattggcttcctgtcaccaggtcgcaacactttgtagacgccattgtagcacgtgtgtagccctgggcgtaagggccatgatgacctgacgtcatcccctccttcctctg

SEQ ID NO: 2174 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aagggcccgggaacgtattcaccgcagcaatgctgatctgcgattactagcaactccgacttcatggggtcgagttgcagaccccaatccgaactgagacaggctttttgagattcgctccacctcacggtatcgcagctcattgtacctgccattgtagcacgtgtggcagcccaagacataaggggcatgactgaccttgacgtcgtccccaccttcc

SEQ ID NO: 2175 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccggacgtattcaccgcgccattgctgatgcgcgattactagcgattccagcttcatgaggtcgagttgcagacctcaatccgaactgagacgccctttgtgattggcttactattactagctcgcaacactctgtaggcgccattgtagcacgtgtgtagccctggacgtaagggccatgatgacctgacgtcatcccctccttcctctctgct

SEQ ID NO: 2176 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
aagacccgggaacgtattcaccgcgtcatgctgatacgcgattactagcgaatccaacttcaagaggtcgagttgcagacctctatccgaactgtgaatggctttttgagattcgcttgctgttaccagctcgctgccctctgtaccatccattgtagcacgtgtgtagccccggacgtaagggccatgatgacttgacgtcgtcccctccttcctctct

SEQ ID NO: 2177 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggcccgggaacgtattcaccgctgccatgctgatcagcgattactagcgattccgacttcaaggagtcgagttgcagactcctatctgtactgaggttgactttttgagattggctccccctcgcgggttcgcgaccctttgtatcaaccattgtagcacgtttgtagccctggacataagggccatgatgacttgacgtcatccccacttcctccac

SEQ ID NO: 2178 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggcccggaacgaattcaccgcggcatgctgatccgcgattactagcaattccggcttcatgcaggcgagttgcagcctgcaatccgaactacgaacggcttatgagattggctccacctcgcggtctcgcgtctcttgtaccgcccattgtagcacgtgtgtagcccaagacataaggggcatgatgatttgacgtcatccccgcttcctccggttgt

SEQ ID NO: 2179 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagtaggcgttttggattagccttcatatcgctatgttgcagccctttgtacgccccattgtagcacgtgtgtagccctgggcataaaggccatgatgacttgacatcatcccctccttcctcacg

SEQ ID NO: 2180 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggcccgggacgtattcgaccgcagcgttgctgatctgcgattactagcgactccgacttcacggggtcgagttgcagaccccgatccgaactgagaccagctttttgggattcgctccaccttacggtctcgcagccctttgtactggccattgtagcatgcgtgaagcccaagacataaggggcatgatgatttgacgtcgtccccaccttcctccg

SEQ ID NO: 2181 - DNA, 220 bp, Unknown
  Description of Unknown: 16S RNA Operational Taxonomic Unit polynucleotide
  Phylum: Chlorobi; Class: SM1B09
aaggcccgggaacgtattcaccgcagcgtgctgatctgcgattactagcgattccagcttcatgcagtcgagttgcagactgcaatctgtactgaggacggttttgggttttctccacctcgcggcttcgcccattgtaccgtccattgtagcacgtgtgtagccctagacgtaaggaccatgatgacttgacgtcatccccacttcctcactacttgcg

SEQ ID NO: 2182 - DNA, 220 bp, Unknown
  Description of Unknown: 16S RNA Operational Taxonomic Unit polynucleotide
  Phylum: Proteobacteria; Class: Gammaproteobacteria; Order: Legionellales; Family: Coxiellaceae
acaaggcccgggaacgtattcaccgcgacaatgctgattcgcgattactagcgattccaacttcatggagtcgagttgcagactccaatccggactacgagacgctttaagagattggctccccctcgcgggttggctaccctctgtacgacccattgtagcacgtgtgtagccctacccataaaggccatgatgacttgacgtcgtccccgccttcctc

SEQ ID NO: 2183 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcatgctgatccgcgattactagcgattccaacttcacgcaggcgagttgcagcctacgatccgaactgagaccggcttttctccgattagcctccccctcgcgggatcgcaacggtttgtaccggccattgtagcacgtgtgtagccctggacataaaggccatgctgacttgacgtcatccccaccttcctcc

SEQ ID NO: 2184 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacaagctttttgcgattggctcccccttgcaggtttggtcagcgctttgttacttgccattgtagcacgtgtgtagccctcggacataaaggccatgaggacttgacgtcatccccacccttcc

SEQ ID NO: 2185 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcgccattgctgatgcgcgattactagcgattccaacttcatgcaggcgagttgcagcctgcaatccgaactgagacgtactttttgtgattggctcaccattgctggcttgcaacactttgtatacgccattgtagcacgtgtgtagccctgggctaagggccatgatgacttgacgtcatcccctcttcctctctg

SEQ ID NO: 2186 - DNA, 220 bp, Unknown
  Description of Unknown: 16S RNA Operational Taxonomic Unit polynucleotide
  Phylum: Proteobacteria; Class: Gammaproteobacteria; Order: Legionellales; Family: Coxiellaceae
aaggcccgggaacgtattcaccgcgacaaatgctgattcgcgattactagcgattccgacttcatggagtcgagttgcagactccaatctggactacgagacgctttaagagattagctccccctcgcggttggcaaccctctgtacgccccattgtagcacgtgtgtagccctacccataaaggccatgatgacttgacgtcgtccccgccttcctccg

SEQ ID NO: 2187 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Rhizobiaceae
aaggcccgggaacgtattcaccgcggcatgctgatccgcgattactagcgattccaacttcatgcactcgagttgcagagtgcaatccgaactgagatggctttttggagattagctcgacatcgctgtctcgctgcccactgtcaccaccattgtagcacgtgtgtagccccagccccgtaagggccatgaggacttgacgtcatcccccacttcctct

SEQ ID NO: 2188 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtaattcgaccgcagcgttgctgatctgcgattactagcgactccgacttcacgggggtcgagttgcagaccccgatccgaactgagaccggctttttgggattcgctccacctcacggcatcgcaaccctttgtaccggccattgtagcatgcgtgaagccctggacataagggggcatgatgacttgacgtcatccccaccttcc

SEQ ID NO: 2189 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggcccgggaacgtattcaccgcgacattctgattcgcgattactagcgattccgacttcacgcagtcgagttgcagactgcgatccggactacgatcggttttgtgggattagctccacctcgcggcttggcaaccctctgtaccgaccattgtagcacgtgtgtagcccaggccgtaagggcccatgatgcttgacgtcatcccccaccttcctccg

SEQ ID NO: 2190 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales
aaggcccgggaacgtattcaccgcggcgtggctgatccgcgattactagcgattccagcttcatgtgggcgagttgcagcccacaatccgaacttagaccggcttttagcgattagcgtactcttgcgagttagcgacgccctgtaccggccattgtagcacgtgtgtcgccctggacgtaagggccatgatgacttgacgtcgtcccccttcctccggt

SEQ ID NO: 2191 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggcccgggaacgtattcaccgcgtcatagctgatacgcgattactagcgattccagcttcatagagtcgagttgcagactccaatccgaactgagaacggctttttgggattggcatctcatcactgagtagcgaccctctgtaccgcccattgtagcacgtgtgttgccctggactaagggccatgatgacttgacgtcgtccctcttcctctctgt

SEQ ID NO: 2192 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aagacccgggaacgtattcaccgcgacattctgattcgcgattactagcgattccgacttcacgcagtcgagttgcagactgcgatccggactacgatcggttttatgggatagctccacctcgcggcttggcaaccctttgtaccgaccattgtagcacgtgtgtagcccaggccgtaagggccatgatgacttgacgtcatccccaccttcctccggt

SEQ ID NO: 2193 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcagcattgctgatctgcgattactagcgattccaacttcatgcaggcgagttgcagcctgcaatccgaactgagacgtccttttgtgattggctcgctatcactagctggcaacactttgtagacgccattgtagcacgtgtgtagccctgggcgtaagggccatgatgacttgacgtcatccctccttcctctctg

SEQ ID NO: 2194 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccaacttcatgtcgtcgagttgcagacgacaatctgaactgagcccggtttctgagatttgctccacctgtcggtcttgcttccctttgtaccgggcattgtagtacgtgtgcagccctggccgtaagggccatactgacttgacgtcatccccaccttcctcctc

SEQ ID NO: 2195 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagacgttttgagattggcttcacatcgctgtgttgctgctctttgtacgtcccattgtagcacgtgtgtagccctgggcataaaggccatgactgaccttgacatcatcccctccttcctcaa

SEQ ID NO: 2196 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Thermomonosporaceae
aagggcccggaacgtattcggaccgcgagcgttgctgatctgcgattactagcgactccgacttcatggggtcgagttgcagaccccaatccgaactgagaccggctttaagggattcgctccaccttgccggtatcgcagccctctgtaccggccattgtagcatgtttgcagcccaagacataaggggcatgatgacttgacgtcatccccaccttcc

SEQ ID NO: 2197 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggcttttttgggattcgctccacctcacggcatcgcaaccctttgtaccggccattgtagcatgcgtgaagccctggacataaggggcatgatgacttgacgtcatcccactcccgagtt

SEQ ID NO: 2198 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
agggcccgggaacgtattcaccgcagcaatgctgatctgcgattactagcgattccgacttcatggagtcgagttgcagactccaatccggactgagatggggtttctgggattggctcaccgtcgccggcttgcagccctctgtccccaccattgtagtacgtgtgtagccctggcgtaagggccatgatgacttgacgtcatccccaccttcctccgg

SEQ ID NO: 2199 - DNA, 220 bp, Unknown
  Description of Unknown: 16S RNA Operational Taxonomic Unit polynucleotide
aaaactaaagtacatttcaccgtaacatgatgatttacgattactagcaattcctccttcataccttcgaattacagaagataatctgaacttcggaatttttatagatttacacaggttttgccttgttactttttataaattcccttgtagcagatctattgcccaaaccatgagggccatattgacttagcataatcctcaccttcctcaatttact

SEQ ID NO: 2200 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobiaceae
aagacccgggaacgtattcacgcggccgtagctgatgccgcattactagcgattccggcttcatggaggcgagttgcagcctccaatccgaactgagcccagttttacagatttcctccacctcgcggtctcggttctcattgtgctgggcattgtagtacgtgtgcagccctaggcgtaagggccatactgacctgacgtcgtcccacttcctccccgt

SEQ ID NO: 2201 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccgacttcatgctctcgagttgcagagaacaatccgaactgagacgactttttgggattggctcaccatcgctggttgcagcctctgtagtcgccattgtagcacgtgtgtagcccaccttgtaagggccatgaggacttgacgtcatccccgccttcctccggaat

SEQ ID NO: 2202 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggccgggacgtattcaccgctgcctgctgatcagcgattactagcgattccgacttcatgtactcgagttgcagagtacaatctgtactgaggtgcacttttgcgattggcttactctcgcgagcttgctgcgctctgtatgcaccattgtagcacgtgtgtagccctggacataagggccatgaggacttgacgtcgtccccaccttcctccggctt

SEQ ID NO: 2203 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcagcatagctgatctgcgattactagcgattccgacttcacgaagtcgagttgcagacttcgatccggactgggatcggcttctgggatttggctccacctcgcggtattgcaaccctctgtaccgaccattgtagtacgtgtgtagccctggccgtaagggccatgatgacttgacgtcatccccaccttcctccg

SEQ ID NO: 2204 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccaacttcatgcactcgagttgcagagtgcaatccgaactgagacgacttttagggattggctcccccgcgggattgcagccctctgtagtcgccattgtagcacgtgtgtagcccaccttgtaaggccatgaggacttgacgtcatccccacttcctccggcttac

SEQ ID NO: 2205 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcgaccgacgagcgttgctgatctgcgattactagcgactccgacttcatggggtcgagttgcagaccccaatccgaactgagaccggcttttaagggattcgctccaccttgcggtatcgcagccctctgtaccggccattgagcatgtttgcagcccaagacataaggggcatgatgacttgacgtcatccccacttcctc

SEQ ID NO: 2206 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccagcttcacgtagtcgagttgcagactacgatccggactacgatgcatttttctgggattggctccacctcgcggctttggcaacccctctgtatgcaccattgtatgacgtgtgaagccctacccataagggccatgaggacttgactcatcccccaccttcctc

SEQ ID NO: 2207 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggacgtattcaccgcagcaatgctgatctgcgattactagcgattccgacttcacggagtcgagttgcagactccgatccggactgagatcaggtttctgggattggctcaccctcgcgggattgcagccctctgtcctgaccattgtagtacgtgtgtagccctggccgtaagggccatgatgacttgacgtcatccccaccttcctccgg

SEQ ID NO: 2208 - DNA, 220 bp, Unknown
  Description of Unknown: 16S RNA Operational Taxonomic Unit polynucleotide
  Phylum: Proteobacteria; Class: Alphaproteobacteria
aaggcccgggaacgtattcaccgcagcctgctgttctgcgattactagcgattccaccttcatgcactcgagttgcagagtgcaatctgaactgggacggttttagagattagcatgctctcgcgagctagctgctcactgtcaccgccattgtagcacgtgtgtagcccagggtgtaagggccatgaggacttgacgtcatccccactcctccggcttg

SEQ ID NO: 2209 - DNA, 220 bp, Unknown
  Description of Unknown: 16S RNA Operational Taxonomic Unit polynucleotide
  Phylum: Proteobacteria; Class: Gammaproteobacteria; Order: Legionellales; Family: Coxiellaceae
aaggcccgggaacgtattcaccgcgacattctgattcgcgattactagcgattccgacttcatggagtgagttgcagactccaatccggactacgatcggctttctgggattggctccccctcgcgggttggctccctctgtaccgaccattgtagcacgtgtgtagccctacccataaaggccatgatgacttgacgtcgtccccgccttcctccggtt

SEQ ID NO: 2210 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacggattcaccgcagtatgctgacctgcgattactagcgattccgccttcatgggcgagttgcagcactgcaatctgaactgaggcagggtttacgggattagctcgccctcgcgggttggctgccccctctgtcccctaccattgtagtacgtgtgtagcccagggacgtaaggggcatgctgacttgacgtcatccccaccttcctc

SEQ ID NO: 2211 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Dietziaceae
aagacccgggaacgtattcaccgcagcgttgctgatctgcgattactagcgactccaacttcatggggtcgagttgcagaccccaatccgaactgagaccagctttaagagattcgctccacctcacggtatcgcagccctctgtactagccattgtagcatgtgtgaagccctagacataaggggcatgatgatttgacgtcatccccaccttcctccg

SEQ ID NO: 2212 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgccctcgagttgcagaggacaatccgaactgagacggctttggagattagctcacccttgcgggtcgctgcccactgtcaccgccattgtagcacgtgtgtagcccagcctgtaagggccatgaggacttgacgtcatccccaccttccccccgtac

SEQ ID NO: 2213 - DNA, 220 bp, Unknown
  Description of Unknown: 16S RNA Operational Taxonomic Unit polynucleotide
aaggcccgggaacgtattcaccgcagcatgtctgatctgcgattactagcgattccgacttcatggagtcgagttgcagactccaatccgaactgagatcggcttttgagattagcttcacatcactgtgttgcaaccctttgtaccgaccattgtagtacgtgtgtagcccaaggtataaaggccatgatgacttgacgtcgtccctccttcctcactg

SEQ ID NO: 2214 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcatgctgatccgcgattactagcgattccgacttcatgctctcgagttgcagagaacaatccggactacgaccggctttcctgggattgctccccctcgcgggttggcagccctctgtaccggccattgtattacgtgtgaagccctacccataagggccatgaggacttgacgtcatccccaccttcctccgg

SEQ ID NO: 2215 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacggattcaccgcagtatgctgacctgcgattactagcgattccgccttcatgcaggcgagttgcagcctgcaatctgaactgaggcagggtttacgggattagctcgccctcgcgggttggctgcccctctgtcctaccattgtagtacgtgtgtagcccggacgtaaggggcatgctgacttgacgtcatcccaccttcctccgggt

SEQ ID NO: 2216 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttctgggattggctccacctcgcggcttggctacccctctgttccgaccattgtatgacgtgtgaagccctacccataaggggccatgaggacttgacgtcatccccaccttcctcc

SEQ ID NO: 2217 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaggtcgagttgcagacctcaatccgaactgagatagagtttttgagattagcagcatgttaccatgtagcagccctttcgttctctaccattgtagcacgtgtgtagccctcgggcataaaggccatgatgacttgacatcatcccctccttcct

SEQ ID NO: 2218 - DNA, 220 bp, Unknown
  Description of Unknown: 16S RNA Operational Taxonomic Unit polynucleotide
  Phylum: Planctomycetes; Class: Phycisphaerae
aaggctcaggaacacattcaccgcggcgtagctgatccgcgattactagcgattccaacttcacggaggcgagttgcagcctccgatctgaactggggggtgatttgtgcgatttcctccagcttgcgctctcggttcgctttgtgcaccccattgtagcacgtgtgtggccctggcataaaggccatgaggacttgacgtcatctccaccttcctccgg

SEQ ID NO: 2219 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcctgggaacgtattcaccgcggcatgctgatccgcgattactagcgattccgacttcatgctctcgagttgcagagaacaatccgaactgagacgacttttgggattggctccccatcgctggtttgctgccctctgtagtcgccattgtagcacgtgtgtagcccaccctgtaagggccatgaggacttgacgtcatccccacttcctccggctt

SEQ ID NO: 2220 - DNA, 220 bp, Unknown
  Description of Unknown: 16S RNA Operational Taxonomic Unit polynucleotide
  Phylum: TM7; Class: TM7-1
aaggcccgggaacgtattcacggtaataatagctgactcaccgttactagcgattccgacttcaagcaggcgagtttcagcctgctatccgaactgggaccggctttgatgggatttgctccccctcgcgggttggctgccctttgtaccggccattgtagcgtgtttgtagcccaaggcataagggaaatactgacctgacatcatccctccttcctcc

SEQ ID NO: 2221 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgctctcgagttgcagagaacaatccgaactgagaccggtttttggggatttgctcactctcgcgagtttgctgcccactgtcaccgccattgtagcaccgtgtgtagcccagcgcgtaagggcccatgaggacttgacgtcatccccacttcctccg

SEQ ID NO: 2222 - DNA, 220 bp, Unknown
  Description of Unknown: 16S RNA Operational Taxonomic Unit polynucleotide
  Phylum: TM7; Class: TM7-3; Order: EW055
aagacccgggaacgtattcaccgcaatttgctgacttgcgattactagcgattccgacttcatggaggcgagtttcagcctccaatccgaactgggaccggctttgatgcgatttgcttcacctcgcggcttcgcagcgcattgtaccggccattgtatcacgtttctagcccaggacgtaagagaaatactgacctgacgtcatcccctcttcctcccg

SEQ ID NO: 2223 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcccgggaacgtattcaccgcggcatgctgatccgcgattactagcgattccgccttcatgctctcgagttgcagagaacaatccgaactgagacggcttttggagattagctagcccttgcgggattgctgctcactgtcaccgccattgtagcacgtgtgtagcccagcttgtaagggccatgaggacttgacgtcatccccaccttcctccggc

SEQ ID NO: 2224 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccaggcttcacacacccgagttgcagagtgcgatccggactacgaccggttttctgggattggctccacctcgcggcttggcgaccctctgttccgaccattgtatgacgtgtgaagccctaccataaggggccatgaggactcgacgtcactccccaccttcctcc

SEQ ID NO: 2225 - DNA, 220 bp, Unknown
  Description of Unknown: 16S RNA Operational Taxonomic Unit polynucleotide
  Phylum: Gemmatimonadetes; Class: Gemmatimonadetes
aaggcccgggaacggattcaccgtggcgtagctgatccacgattactagcgattccaacttcatgcagtcgagttacagactgcaatccgaacttagaccgggtttttccgattcgctcactctcacgagctcgcagcggtttgtcccggccattgtagcacgtgtgtagccctggacgtaaggaccatgatgacttgacgtcgtcccccttcctccggt

SEQ ID NO: 2226 - DNA, 220 bp, Unknown
  Description of Unknown: 16S RNA Operational Taxonomic Unit polynucleotide
aaagggcagggacgtagtcaacgcgagctgatgactcgcgcttactaggaattcctcgttgaagaccaacaattgcaatgatctatccccatcacgatgaaatttcaaagattacccgggcctgtcggccaaggtgtgaactcgttgaatacatcagtgtagcgcgcgtgcggcccagaacatctaagggcatcacagacctgtatgctcaacttcctgg

SEQ ID NO: 2227 - DNA, 253 bp, Lentzea sp.
  OTU_2152; Phylum: Actinobacteria; Class: Actinobacteria; Order: Actinomycetales; Family: Actinosynnemataceae
tacgtagggcgcaagcgttatccggaattattgggcgtaaagagctcgtaggcggtttgtcgcgtcggccgtgaaaacttggggcttaaccccaagcttgcggtcgatacgggcagacttgagttcggcaggggagactggaattcctggtgtagcggtgaaatgcgcagatatcaggaggaacaccggtggcgaaggcgggtctctgggccgacactgacgctgaggagcgaaagcgtggggatcaaacagg

SEQ ID NO: 2228 - DNA, 253 bp, Unknown
  Description of Unknown: Bacterium polynucleotide
  OTU_90; Phylum: Actinobacteria; Class: Actinobacteria; Order: Actinomycetales; Family: Actinosynnemataceae
tacgtagggtgcgagcgttgtccggaattattgggcgtaaagagctcgtaggcggtttgtcgcgtcggccgtgaaaacttggggcttaaccccgagcctgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 2229 - DNA, 253 bp, Brachybacterium sp.
  OTU_309; Phylum: Actinobacteria; Class: Actinobacteria; Order: Actinomycetales; Family: Dermabacteraceae
tacgtagggcgcaagcgttgtccggaattattgggcgtaaagagctcgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgaggagcgaaagcatgggtagcgaacagg

SEQ ID NO: 2230 - DNA, 253 bp, Unknown
  Description of Unknown: Bacterium polynucleotide
  OTU_2984; Phylum: Actinobacteria; Class: Actinobacteria; Order: Actinomycetales; Family: Geodermatophilaceae
tacgtagggtgcaagcgttgtccggaattattgggcgtaaagagctcgtaggcggtttgttgcgtcggctgtgaaatcccgaggctcaacctcgggtctgcagtcgatacgagcaaactagagtgttgcaggggagactggaattcctggtgtagcggtgaaatgcgcagatatcagggggaacaccggtggcgaaggcgggtctctgggcagcaactgacgctgaggagcgaaagcgtggggagcgaacagg

SEQ ID NO: 2231 - DNA, 253 bp, Glycomyces sp.
  OTU_132; Phylum: Actinobacteria; Class: Actinobacteria; Order: Actinomycetales; Family: Glycomycetaceae
gacgtagggcgcgagcgttgtccggatttattgggcgtaaagggctcgtaggcggttgattgcgtccgccgtgaaaggcctcggcttaaccggggttttgcggtggatacgggtcgacttgaggcaattaggggagatcggaattctacgtgtagcggtgaaatgcgcagatatgtggaggaacaccggtggcgaaggcggatctctgggattgttctgacgctgaggagcgaaagcgtggggagcgaacagg

SEQ ID NO: 2232 - DNA, 253 bp, Phycicoccus sp.
  OTU_1588; Phylum: Actinobacteria; Class: Actinobacteria; Order: Actinomycetales; Family: Intrasporangiaceae
tacgtagggtgcgagcgttgtccggaattattgggcgtaaagagcttgtaggcggtttgtcgcgtctgccgtgaaatttcgaggctcaacctcgaacttgcggtgggtacgggcagactagagtgtggtaggggagactggaattcctggtgtagcggtgaaatgcgcagatatcaggaggaacaccgatggcgaaggcaggtctctgggccactactgacgctgagaagcgaaagcatggggagcgaacagg

SEQ ID NO: 2233 - DNA, 253 bp, Unknown
  Description of Unknown: Bacterium polynucleotide
  OTU_161; Phylum: Actinobacteria; Class: Actinobacteria; Order: Actinomycetales; Family: Kineosporiaceae
tacgtagggtgcaagcgttgtccggaattattgggcgtaaagagctcgtaggcggtctgtcgcgtctgctgtgaaaactcagggcttaaccctgagcttgcagtgggtacgggcagactagagtgcggtaggggagactggaattcctggtgtagcggtgaaatgcgcagatatcaggaggaacaccggtggcgaaggcgggtctctgggccgtaactgacgctgaggagcgaaagcatggggagcgaacagg

SEQ ID NO: 2234 - DNA, 253 bp, Unknown
  Description of Unknown: Bacterium polynucleotide
  OTU_1207; Phylum: Actinobacteria; Class: Actinobacteria; Order: Actinomycetales; Family: Kineosporiaceae
tacgtagggtgcaagcgttgtccggaattattgggcgtaaagagctcgtaggcggtttgtcgcgtccgctgtgaaaactcggggcttaaccccgggcctgcagtgggtacgggcagactagagtgcggtaggggaggctggaattcctggtgtagcggtgaaatgcgcagatatcaggaggaacaccggtggcgaaggcgggtctctgggccgtaactgacgctgaggagcgaaagcgtggggagcgaacagg

SEQ ID NO: 2235 - DNA, 253 bp, Unknown
  Description of Unknown: Bacterium polynucleotide
  OTU_28; Phylum: Actinobacteria; Class: Actinobacteria; Order: Actinomycetales; Family: Microbacteriaceae
tacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 2236 - DNA, 253 bp, Unknown
  Description of Unknown: Bacterium polynucleotide
  OTU_302; Phylum: Actinobacteria; Class: Actinobacteria; Order: Actinomycetales; Family: Microbacteriaceae
tacgtagggtgcaagcgttatccggaattattgggcgtaaagagctcgtaggcggtttgtcgcgtctgctgtgaaaactggaggctcaacctccagcctgcagtgggtacgggcaaactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 2237 - DNA, 253 bp, Unknown
  Description of Unknown: Bacterium polynucleotide
  OTU_3428; Phylum: Actinobacteria; Class: Actinobacteria; Order: Actinomycetales; Family: Microbacteriaceae
tacgtagggtgcaagcgttatccggaattattgggcgtaaagagctcgtaggcggtttgtcgcgtctgctgtgaaaaccggaggctcaacctccgacctgcagtgggtacgggcaaactagagtgcgataagggagattggaattcctggtgtagcggtggaatgcgcagatatcaggaggaacaccgatggcgaaggcagctctctgggccgtaactgacgctgaggagcgaaagcgtggagagcgaacagg

SEQ ID NO: 2238 - DNA, 253 bp, Arthrobacter psychrolactophilus
  OTU_94; Phylum: Actinobacteria; Class: Actinobacteria; Order: Actinomycetales; Family: Micrococcaceae
tacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 2239 - DNA, 253 bp, Micrococcus sp.
  OTU_2968; Phylum: Actinobacteria; Class: Actinobacteria; Order: Actinomycetales; Family: Micrococcaceae
tacgtagggtgcgagcgttatccggaattattgggcgtaaggagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgagggcaggtctctgggctgtaactgacgctgaggagcgaaagcatggggagcgaacagg

SEQ ID NO: 2240 - DNA, 253 bp, Unknown
  Description of Unknown: Bacterium polynucleotide
  OTU_179; Phylum: Actinobacteria; Class: Actinobacteria; Order: Actinomycetales; Family: Micrococcaceae
tacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacagg

SEQ ID NO: 2241 - DNA, 253 bp, Unknown
  Description of Unknown: Bacterium polynucleotide
  OTU_200; Phylum: Actinobacteria; Class: Actinobacteria; Order: Actinomycetales; Family: Micromonosporaceae
gacgtagggcgcgagcgttgtccggatttattgggcgtaaagagctcgtaggcggcttgtcgcgtcgactgtgaaaacccgcggctcaaccgcgggcctgcagccgatacgggcaggctagagttcggtaggggagactggaattcctggtgtagcggtgaaatgcgcagatatcaggaggaacaccgatggcgaaggcaggtctctgggccgatactgacgctgaggagcgaaagcgtggggagcgaacagg

SEQ ID NO: 2242 - DNA, 253 bp, Mycobacterium sp.
  OTU_350; Phylum: Actinobacteria; Class: Actinobacteria; Order: Actinomycetales; Family: Mycobacteriaceae
tacgtagggtccgagcgttgtccggaattactgggcgtaaagagctcgtaggtggtttgtcgcgttgttcgtgaaaactcacagcttaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 2243 - DNA, 253 bp, Aeromicrobium sp.
  OTU_100; Phylum: Actinobacteria; Class: Actinobacteria; Order: Actinomycetales; Family: Nocardioidaceae
tacgtagggtccgagcgttgtccggaattattgggcgtaaagggctcgtaggcggtttgtcgcgtcgggagtgaaaactcagggctcaaccctgagcgtgcttccgatacgggcagactagaggtatgcaggggagaacggaattcctggtgtagcggtggaatgcgcagatatcaggaggaacaccggtggcgaaggcggttctctgggcattacctgacgctgaggagcgaaagcatggggagcgaacagg

SEQ ID NO: 2244 - DNA, 253 bp, Aeromicrobium sp.
  OTU_3177; Phylum: Actinobacteria; Class: Actinobacteria; Order: Actinomycetales; Family: Nocardioidaceae
tacgtagggtccgagcgttgtccggaattattgggcgtaaagggctcgtaggcggtttgtcacgtcgggcgtgaaaactcagggctcaaccctgagcgtgcgttcgatacgggcagactagaggtatgcaggggagaacggaattcctggtgtagcggtggaatgcgcagatatcaggaagaacaccggtggcgaaggcggctctctgggccttacctgacgctgaggagcgaaagcatgggtagcgaacagg

SEQ ID NO: 2245 - DNA, 253 bp, Kribbella sp.
  OTU_1142; Phylum: Actinobacteria; Class: Actinobacteria; Order: Actinomycetales; Family: Nocardioidaceae
tacgtagggtgcaagcgttgtccggaattattgggcgtaaagggctcgtaggcggttcgtcacgtcgggagtgaaaactcggagctcaactccgagccggcttccgatacgggcagactagaggtaggcaggggagagtggaactcctggtgtagcggtggaatgcgcagatatcaggaagaacaccagtggcgaaggcggctctctgggccttacctgacgctgaggagcgaaagcgtgggtagcgaacagg

SEQ ID NO: 2246 - DNA, 253 bp, Kribbella sp.
  OTU_238; Phylum: Actinobacteria; Class: Actinobacteria; Order: Actinomycetales; Family: Nocardioidaceae
tacgtagggtccgagcgttgtccggaattattgggcgtaaagggctcgtaggcggttcgtcacgtcgggagtgaaaactcggggcttaaccccgagcctgcttccgatacgggcagactagaggtaggcaggggagagcggaactcctggtgtagcggtggaatgcgcagatatcaggaagaacaccggtggcgaaggcggctctctgggccttacctgacgctgaggagcgaaagcgtgggtagcgaacagg

SEQ ID NO: 2247 - DNA, 253 bp, Unknown
  Description of Unknown: Bacterium polynucleotide
  OTU_730; Phylum: Actinobacteria; Class: Actinobacteria; Order: Actinomycetales; Family: Nocardioidaceae
tacgtagggtgcgagcgttgtccggaattattgggcgtaaagggctcgtaggcggtctgttgcgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 2248 - DNA, 253 bp, Unknown
  Description of Unknown: Bacterium polynucleotide
  OTU_992; Phylum: Actinobacteria; Class: Actinobacteria; Order: Actinomycetales; Family: Nocardioidaceae
tacgtagggtgcgagcgttgtccggaattattgggcgtaaagggctcgtaggcggtttgtcgcgtcgggagtgaaaacgccgtgcttaacacggcgcttgctttcgatacgggcagactagaggtattcaggggagaacggaattcctggtgtagcggtgaaatgcgcagatatcaggaggaacaccggtggcgaaggcggttctctgggaatgacctgacgctgaggagcgaaagtgtggggagcgaacagg

SEQ ID NO: 2249 - DNA, 253 bp, Cellulosimicrobium sp.
  OTU_392; Phylum: Actinobacteria; Class: Actinobacteria; Order: Actinomycetales; Family: Promicromonosporaceae
tacgtagggcgcaagcgttgtccggaattattgggcgtaaagagctcgtaggcggtttgtcgcgtctggtgtgaaaactcgaggctcaacctcgagcttgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacagg

SEQ ID NO: 2250 - DNA, 253 bp, Promicromonospora sp.
  OTU_91; Phylum: Actinobacteria; Class: Actinobacteria; Order: Actinomycetales; Family: Promicromonosporaceae
tacgtagggcgcaagcgttgtccggaattattgggcgtaaagagctcgtaggcggtctgtcgcgtctggtgtgaaatcccatggctcaactgtgggcttgcatcgggtacgggcagactagagtgctgtaggggagactggaattcctggtgtagcggtggaatgcgcagatatcaggaggaacaccgatggcgaaggcaggtctctgggcagttactgacgctgaggagcgaaagcatggggagcgaacagg

SEQ ID NO: 2251 - DNA, 254 bp, Pseudonocardia sp.
  OTU_134; Phylum: Actinobacteria; Class: Actinobacteria; Order: Actinomycetales; Family: Pseudonocardiaceae
tacgtagggtgcgagcgttgtccggaattattgggcgtaaagagctcgtaggcggtgtgtcacgtcgatcgtgaaaacttggggcttaaccctgagcgtgcggtcgatacgggcatcactagagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 2252 - DNA, 253 bp, Streptomyces mirabilis
  OTU_573; Phylum: Actinobacteria; Class: Actinobacteria; Order: Actinomycetales; Family: Streptomycetaceae
tacgtagggcgcaagcgttgtccggaattattgggcgtaaagagctcataggcggcttgtcacgtcgggtgtgaaagcccggggcttaaccccgggcctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 2253 - DNA, 254 bp, Streptomyces sp.
  OTU_3556; Phylum: Actinobacteria; Class: Actinobacteria; Order: Actinomycetales; Family: Streptomycetaceae
tacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagacgaaagctaggggagcgaatggg

SEQ ID NO: 2254 - DNA, 253 bp, Unknown
  Description of Unknown: Bacterium polynucleotide
  OTU_88; Phylum: Actinobacteria; Class: Actinobacteria; Order: Actinomycetales; Family: Streptomycetaceae
tacgtagggcgcaagcgttgtccggaattattgggcgtaaagagctcgtaggcggtctgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 2255 - DNA, 253 bp, Unknown
  Description of Unknown: Bacterium polynucleotide
  OTU_409; Phylum: Actinobacteria; Class: Actinobacteria; Order: Actinomycetales; Family: Streptomycetaceae
tacgtagggtgcgagcgttgtccggaattattgggcgtaaagagctcgtaggcggcttgtcacgtcggatgtgaaagcccggggcttaaccccgggtctgcattcgatacgggcaggctagagtgtggtaggggagatcagaattcctggtgtagcggtgaaatgcgcaaatatcaggaggaacaccggtggcgaaggcggatctctgggccattactgacgctgaggagcgaaagcgtggggagcgaacagg

SEQ ID NO: 2256 - DNA, 253 bp, Unknown
  Description of Unknown: Bacterium polynucleotide
  OTU_882; Phylum: Actinobacteria; Class: Actinobacteria; Order: Actinomycetales
tacgtagggtgcaagcgttgtccggaattattgggcgtaaagagttcgtaggcggtttgtcgcgtccgttgtgaaagcttggggctcaaccccaagtctgcagtggatacgggcagactagagtcaggtaggggagaacggaattcctggtgtagcggtgaaatgcgcagatatcaggaggaacaccggtggcgaaggcggttctctgggcctgtactgacgctgaggaacgaaagcgtggggagcgaacagg

SEQ ID NO: 2257 - DNA, 253 bp, Unknown
  Description of Unknown: Bacterium polynucleotide
  OTU_713; Phylum: Actinobacteria; Class: Thermoleophilia; Order: Gaiellales; Family: Gaiellaceae
tacgtagggggcaagcgttgtccggatttattgggcgtaaagagcgtgtaggcggccattcaggtcagctgtgaaaactcgaggctcaacctcgagacgtcggttgaaaccgtttggctagagtccggaagaggagagtggaattcccggtgtagcggtgaaatgcgcagatatcgggaagaacacccgtggcgaaggcggctctctgggacggtactgacgctgagacgcgaaagcgtggggagcgaacagg

SEQ ID NO: 2258 - DNA, 253 bp, Chitinophaga sp.
  OTU_402; Phylum: Bacteroidetes; Class: Saprospirae; Order: Saprospirales; Family: Chitinophagaceae
tacggagggtgcaagcgttatccggattcactgggtttaaagggtgcgtaggcggattattaagtccgtggtgaaatctccaagcttaacttggaaactgccatggatactattagtcttgaatgttgtggaggttagcggaatatgtcatgtagcggtgaaatgcatagatatgacatagaacaccaattgcgaaggcagctggctacacaaatattgacgctgaggcacgaaagcgtggggatcaaacagg

SEQ ID NO: 2259 - DNA, 253 bp, Chitinophaga sp.
  OTU_3325; Phylum: Bacteroidetes; Class: Saprospirae; Order: Saprospirales; Family: Chitinophagaceae
tacggagggtgcaagcgttatccggattcactgggcttaaagggtgcgtaggcggatttgtaagtccgtggtgaaatctctaagcttaacttggaaactgccatggatactataagtcttgaatattgtggaggttagcggaatatgtcatgtagcggtgaaatgcatagatacgacatagaacaccaattgcgaaggcagctggctacacaaatattgacgctgatgcacgaaagcgtggggatcaaacagg

SEQ ID NO: 2260 - DNA, 253 bp, Lacibacter cauensis
  OTU_218; Phylum: Bacteroidetes; Class: Saprospirae; Order: Saprospirales; Family: Chitinophagaceae
tacggagggtgcaagcgttatccggattcactgggtttaaagggagcgtaggtggacttttaagtcagtggtgaaatctctgggcttaacccggaaactgccattgatactattagtcttgaattctctggaggtaagcggaatatgtcatgtagcggtgaaatgcttagatatgacatagaacacccattgcgaaggcagcttactacggagacattgacactgaggctcgaaagcgtggggatcaaacagg

SEQ ID NO: 2261 - DNA, 253 bp, Sediminibacterium sp.
  OTU_57; Phylum: Bacteroidetes; Class: Saprospirae; Order: Saprospirales; Family: Chitinophagaceae
tacggagggtgcaagcgttatccggattcactgggtttaaagggtgcgtaggcgggtatgtaagtcagtggtgaaataccggagcttaacttcggaactgccattgatactatatatcttgaatattgtggaggtaagcggaatatgtcatgtagcggtgaaatgcttagagatgacatagaacaccgattgcgaaggcagcttgctacgcaaatattgacgctgaggcacgaaagcgtggggatcaaacagg

SEQ ID NO: 2262 - DNA, 253 bp, Unknown
  Description of Unknown: Bacterium polynucleotide
  OTU_213; Phylum: Bacteroidetes; Class: Saprospirae; Order: Saprospirales; Family: Chitinophagaceae
tacggagggtgcaagcgttatccggattcactgggtttaaagggtgcgtaggtgggttggtaagtcagtggtgaaatctccgagcttaacttggaaactgccgttgatactatcaatcttgaatatcgcgtaggtaagcggaatatgtcatgtagcggtgaaatgcttagatatgacatagaacaccaattgcgaaggcagcttacttcacgatcattgacactgaggcacgaaagcgtggggagcaaacagg

SEQ ID NO: 2263 - DNA, 253 bp, Unknown
  Description of Unknown: Bacterium polynucleotide
  OTU_362; Phylum: Bacteroidetes; Class: Saprospirae; Order: Saprospirales; Family: Chitinophagaceae
tacggagggtgcaagcgttatccggattcactgggtttaaagggtgcgtaggtgggttggtaagtcagtggtgaaatccccgagcttaacttgggaactgccattgatactatcagtcttgaataccgtggaggttagcggaatatgtcatgtagcggtgaaatgcttagatatgacatagaacaccaattgcgaaggcagctggctacacgaatattgacactgaggcacgaaagcgtggggatcaaacagg

SEQ ID NO: 2264 - DNA, 253 bp, Unknown
  Description of Unknown: Bacterium polynucleotide
  OTU_348; Phylum: Bacteroidetes; Class: Saprospirae; Order: Saprospirales; Family: Chitinophagaceae
tacggagggtgcaagcgttatccggatttactgggtttaaagggtgcgtaggtgggtaggtaagtcagtggtgaaatcttcaagcttaacttggaaactgccattgatactatttatcttgaatactttggaggtaagcggaatatgtcatgtagcggtgaaatgcttagatatgacatagaacaccaattgcgaaggcagcttactacacagttattgacactgaggcacgaaagcgtggggatcaaacagg

SEQ ID NO: 2265 - DNA, 253 bp, Unknown
  Description of Unknown: Bacterium polynucleotide
  OTU_208; Phylum: Bacteroidetes; Class: Saprospirae; Order: Saprospirales; Family: Chitinophagaceae
tacggagggtgcaagcgttatccggattcactgggtttaaagggagcgcaggcggatttgtaagtcagtggtgaaaggcttaagcttaacttgggaactgccattgatactataagtcttgaatgttgttgaggtttgcggaatgggtcatgtagcggtgaaatgcatagatatgacccggaacacctattgcgaaggcagcaggctaaacaaatattgacgctgaggctcgaaagcgtggggatcaaacagg

SEQ ID NO: 2266 - DNA, 253 bp, Unknown
  Description of Unknown: Bacterium polynucleotide
  OTU_237; Phylum: Bacteroidetes; Class: Saprospirae; Order: Saprospirales; Family: Chitinophagaceae
tacggagggtgcaagcgttatccggattcactgggtttaaagggtgcgtaggtgggctagtaagtccgtggtgaaatctctgagcttaactcggaaactgccgtggatactattagtcttgaatctcgtggaggtaagcggaatatgtcatgtagcggtgaaatgcttagatatgacatagaacaccgatagcgaaggcagcttgctacacgagtattgacactgaggcacgaaagcgtggggatcaaacagg

SEQ ID NO: 2267 - DNA, 253 bp, Algoriphagus terrigena
  OTU_163; Phylum: Bacteroidetes; Class: Cytophagia; Order: Cytophagales; Family: Cyclobacteriaceae
tacggagggtgcaagcgttgtccggatttattgggtttaaagggtgcgtaggcggctatttaagtcagcggtgaaagacatcggctcaaccgatgcagtgccattgatactggatagcttgagtgttggaggggtacatggaattgatggtgtagcggtgaaatgcatagataccatcaggaacaccgatagcgaaggcattgtactggccaacaactgacgctgaggcacgaaagcatgggtagcgaacagg

SEQ ID NO: 2268 - DNA, 253 bp, Dyadobacter sp.
  OTU_112; Phylum: Bacteroidetes; Class: Cytophagia; Order: Cytophagales; Family: Cytophagaceae
tacggagggtgcgagcgttgtccggatttattgggtttaaagggtgcgtaggtggctgtttaagtcagtggtgaaatacggttgctcaacaatcgaggtgccattgatactgaatagcttgaaataattggaggctgccggaatggatggtgtagcggtgaaatgcatagatatcatccagaacaccgattgcgaaggcaggtggctacgattggtttgacactgaggcacgaaagcatggggagcaaacagg

SEQ ID NO: 2269 - DNA, 253 bp, Dyadobacter sp.
  OTU_120; Phylum: Bacteroidetes; Class: Cytophagia; Order: Cytophagales; Family: Cytophagaceae
tacggagggtgcgagcgttgtccggatttattgggtttaaagggtgcgtaggtggctttttaagtcagtggtgaaatacagccgctcaacggttgaggtgccattgatactgaagagcttgaaacaagtggaggctgccggaatggatggtgtagcggtgaaatgcatagatatcatccagaacaccgattgcgaaggcaggtggctacgtttgatttgacactgaggcacgaaagcatggggagcaaacagg

SEQ ID NO: 2270 - DNA, 254 bp, Emticicia sp.
  OTU_234; Phylum: Bacteroidetes; Class: Cytophagia; Order: Cytophagales; Family: Cytophagaceae
tacgtaggtggcgagcgttatccggatttattgggtttaaagggtgcgtaggcggctgattaagtcagcggtgaaaggtagcagcttaactgttttacatgccgttgatactggttagcttgagttgacagaaggcagatagaatttctggtgtagcggtgaaatgcttagataccaggaggaataccgattgcgaaggcagtctgctgcagtcacactgacgctgaggcacgaaagtgcggggatcaaacagg

SEQ ID NO: 2271 - DNA, 253 bp, Unknown
  Description of Unknown: Bacterium polynucleotide
  OTU_210; Phylum: Bacteroidetes; Class: Cytophagia; Order: Cytophagales; Family: Cytophagaceae
tacgtaggtggcaagcgttgtccggatttattgggtttaaagggtgcgtaggcggtctattaagtcagtggtgaaatatcgcagcttaactgtgagggtgccattgatactgatggacttgagtgaagtcgaagtaggcggaattgacggtgtagcggtgaaatgcttagatatcgtcaagaacaccgatagtgaagacagcttactaggcttatactgacgctgaggcacgaaagtgtggggatcaaacagg

SEQ ID NO: 2272 - DNA, 253 bp, Unknown
  Description of Unknown: Bacterium polynucleotide
  OTU_187; Phylum: Bacteroidetes; Class: Cytophagia; Order: Cytophagales; Family: Cytophagaceae
tacgtaggtggcaagcgttgtccggatttattgggtttaaagggtgcgtaggtggttccataagtcagtggtgaaatacggcagcttaactgtcgaggtgccattgatactgcggaacttgagtacagacgaggtaggcggaattgacggtgtagcggtgaaatgcttagatatcgtcaagaacaccgatagcgaaggcagcttactagactgtaactgacactgaggcacgaaagtgtggggatcaaacagg

SEQ ID NO: 2273 - DNA, 253 bp, Unknown
  Description of Unknown: Bacterium polynucleotide
  OTU_152; Phylum: Bacteroidetes; Class: Cytophagia; Order: Cytophagales; Family: Cytophagaceae
tacggagggtgcaagcgttgtccggatttattgggtttaaagggtgcgtaggtggctgtttaagtcagtggtgaaagcctgcagcttaactgtaggactgccattgatactgaatagcttgagtactgatgaggtaggcggaattgatagtgtagcggtgaaatgcatagatattatcaagaacaccgattgcgaaggcagcttactaaggagttactgacactgaggcacgaaagcgtggggatcaaacagg

SEQ ID NO: 2274 - DNA, 253 bp, Unknown
  Description of Unknown: Bacterium polynucleotide
  OTU_1201; Phylum: Bacteroidetes; Class: Cytophagia; Order: Cytophagales; Family: Cytophagaceae
tacgtaggtggcaagcgttgtccggatttattgggtttaaagggtgcgtaggcggttctataagtcagtggtgaaatacggcagctcaactgtcgaggtgccattgatactgtaggactagagtactgttgaggtaggcggaatggacggtgtggcggtgaaatgcttagatatcgtccagaacaccgatagcgaaggcagcttactaaggagtaactgacgctgaggcacgaaagtgtggggatcaaacagg

SEQ ID NO: 2275 - DNA, 253 bp, Unknown
  Description of Unknown: Bacterium polynucleotide
  OTU_287; Phylum: Bacteroidetes; Class: Cytophagia; Order: Cytophagales; Family: Cytophagaceae
tacgtaggtggcgagcgttgtccggatttattgggtttaaagggtgcgtaggcggttttgtaagtcagtgctgaaatatcccggcttaaccgggagggtggcattgatactgcaggacttgagtaaagttgaggtgggcggaattgacggtgtagcggtgaaatgcttagatatcgtcaagaacaccgattgcgaaggcagctcactaagctttaactgacgctgaggcacgaaagtgtggggatcaaacagg

SEQ ID NO: 2276 - DNA, 253 bp, Unknown
  Description of Unknown: Bacterium polynucleotide
  OTU_377; Phylum: Bacteroidetes; Class: Cytophagia; Order: Cytophagales; Family: Cytophagaceae
tacgtaggtggcaagcgttgtccggatttattgggtttaaagggtgcgtaggcggtcttttaagtcagtgctgaaatactccagcttaactggaggggtggcattgatactggaagacttgagtgtagtcgaagtaggcggaattgacggtgtagcggtgaaatgcttagatatcgtcaagaacaccgatagtgaagacagcttactaggctacaactgacgctgaggcacgaaagtgtggggatcaaacagg

SEQ ID NO: 2277 - DNA, 253 bp, Unknown
  Description of Unknown: Bacterium polynucleotide
  OTU_2342; Phylum: Bacteroidetes; Class: Cytophagia; Order: Cytophagales; Family: Cytophagaceae
tacgtaggtggcaagcgttgtccggatttattgggcttaaagggtgcgtaggcggttatataagtcagtgctgaaatatcccggcttaaccgggagggtggcattgatactgtatgacttgagtaaagttgaggttggcggaattgacggtgtagcggtgaaacgcttagatatcgtcaagaacaccgattgcgaaggcagctaactaagctttaactgacgctgaggcacgaaagtgtggggatcaaacagg

SEQ ID NO: 2278 - DNA, 253 bp, Unknown
  Description of Unknown: Bacterium polynucleotide
  OTU_487; Phylum: Bacteroidetes; Class: Cytophagia; Order: Cytophagales
tacggagggtgcaagcgttgtccggatttattgggtttaaagggtgcgtaggtggcttattaagtcagtgtttaaagtcaatagctcaactattggaatggcattgatactgatgagcttgagtaaagttgaggtagacagaattgatggtgtagcggtgaaatgcatagatatcatcaagaataccgattgcgaaggcagtttactaagctttaactgacactgaggcacgaaagtgtggggatcaaacagg

SEQ ID NO: 2279 - DNA, 253 bp, Fluviicola sp.
  OTU_276; Phylum: Bacteroidetes; Class: Flavobacteriia; Order: Flavobacteriales; Family: Cryomorphaceae
tacggagggtgcaagcgttatccggaatcattgggtttaaagggtccgcaggcggtcttataagtcagtggtgaaagcctacagctcaactgtagaactgccattgatactgtaagacttgaattcgatcgaagtgggcggaatatgacatgtagcggtgaaatgcttagatatgtcatagaacaccgatagcgaaggcagctcactaggtctggattgacgctcagggacgaaagcgtggggagcaaacagg

SEQ ID NO: 2280 - DNA, 253 bp, Flavobacterium columnare
  OTU_141; Phylum: Bacteroidetes; Class: Flavobacteriia; Order: Flavobacteriales; Family: Flavobacteriaceae
tacggaggatccaagcgttatccggaatcattgggtttaaagggtccgtaggcggttttataagtcagtggtgaaatctggtcgctcaacgatcaaacggccattgatactgtagaacttgaattacttggaagtaactagaatatgtagtgtagcggtgaaatgcttagagattacatggaataccaattgcgaaggcaggttactacgagtatattgacgctgatggacgaaagcgtggggagcgaacagg

SEQ ID NO: 2281 - DNA, 253 bp, Flavobacterium succinicans
  OTU_148; Phylum: Bacteroidetes; Class: Flavobacteriia; Order: Flavobacteriales; Family: Flavobacteriaceae
tacggaggatccaagcgttatccggaatcattgggtttaaagggtccgtaggcggtttggtaagtcagtggtgaaagcccatcgctcaacggtggaacggccattgatactgccagacttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 2282 - DNA, 253 bp, Flavobacterium succinicans
  OTU_3571; Phylum: Bacteroidetes; Class: Flavobacteriia; Order: Flavobacteriales; Family: Flavobacteriaceae
tacggaggatccgagcgttatccggaatcattgggtttaaagggtccgtaggcggtttaataagtcagtggtgaaagcccatcgctcaacggtggaacggccattgatactgttaaacttgaattattaggaagtaactagaatatgtagtgtagcggtgaaatgcttagagattacatggaataccaattgcgaaggcaggttactactaatgggttggcgctgatggacgaaagcgtgggtagcgaacagg

SEQ ID NO: 2283 - DNA, 253 bp, Flavobacterium sp.
  OTU_3528; Phylum: Bacteroidetes; Class: Flavobacteriia; Order: Flavobacteriales; Family: Flavobacteriaceae
tacggaggatccaagcgttatccggaatcattgggtttaaagggtccgtaggcggcttgataagtcagtggtgaaagcccatcgctcaacgatggaacggccattgatactgtcagacttgaattactgggaagtaactagaatatgtagtgtagcggtgaaatgcttagatattacatggaataccaattgcgaaggcaggttactaccagtggattgacgctgatggacgaaagcgtggggagcgaacagg

SEQ ID NO: 2284 - DNA, 253 bp, Pedobacter sp.
  OTU_67; Phylum: Bacteroidetes; Class: Sphingobacteriia; Order: Sphingobacteriales; Family: Sphingobacteriaceae
tacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacagg

SEQ ID NO: 2285 - DNA, 253 bp, Pedobacter sp.
  OTU_109; Phylum: Bacteroidetes; Class: Sphingobacteriia; Order: Sphingobacteriales; Family: Sphingobacteriaceae
tacggaggatccaagcgttatccggatttattgggtttaaagggtgcgtaggcggcttattaagtcaggggtgaaagacggtggctcaaccatcgcagtgcccttgatactgatgagcttgaatgaactagaggtaggcggaatgtgacaagtagcggtgaaatgcatagatatgtcacagaacaccgattgcgaaggcagcttactatggttttattgacgctgaggcacgaaagcgtggggatcaaacagg

SEQ ID NO: 2286 - DNA, 253 bp, Unknown
  Description of Unknown: Bacterium polynucleotide
  OTU_3687; Phylum: Bacteroidetes; Class: Sphingobacteriia; Order: Sphingobacteriales; Family: Sphingobacteriaceae
tacggaggatccaagcgttatccggatttattggatttaaagggtgcgtaggcggcttattaagtcaggggtgaaagacggtggctcaaccatcgcagtgcccttgctactgatgagcttgaatacattagaggtaggcggaatgtgacaagtagcggtgaaatgcatagatatgtcacagaacaccgattgcgaaggcagcttactatgatgagattgacgctgaggcacgaaagcgtggggatcaaacagg

SEQ ID NO: 2287 - DNA, 253 bp, Unknown
  Description of Unknown: Bacterium polynucleotide
  OTU_3184; Phylum: Bacteroidetes; Class: Sphingobacteriia; Order: Sphingobacteriales; Family: Sphingobacteriaceae
tacggaggatccgagcgttatccggatttattgggtttaaagggtgcgtaggcggcctattaagtcaggggtgaaagacggtagcttaactatcgcagtgcctttgatactgataggcttgaatgtacttgaggtaggcggaatgtgacaagtagcggtgaaatgcatagatatgtcacagaacaccaattgcgaaggcagcttgctaaagtatgattgacgctgaggcacgaaagcgtggggatcaaacagg

SEQ ID NO: 2288 - DNA, 253 bp, Unknown
  Description of Unknown: Bacterium polynucleotide
  OTU_3212; Phylum: Bacteroidetes; Class: Sphingobacteriia; Order: Sphingobacteriales; Family: Sphingobacteriaceae
tacggaggatccaagcgttatccggatttattgggtttaaagggtgcgtaggcggcctattaagtcaggggtgaaagacggtagctttactatcgcagtgcccttggtactgatgggcttgaatacactagaggtaggcggaatgtgacaagtagcggtgaaatgcatagatatgtcacagaacaccaattgcgaaggcagcttactatggtgtcattgacgctgaggcacgaaagcgtggggatcaaacagg

SEQ ID NO: 2289 - DNA, 252 bp, Unknown
  Description of Unknown: Bacterium polynucleotide
  OTU_3301; Phylum: Bacteroidetes; Class: Sphingobacteriia; Order: Sphingobacteriales; Family: Sphingobacteriaceae
tacgaggatccaagcgttatccggatttattgggtttaaagggtgcgtaggtggctttttaagtcaggggtgaaagacggtagcttaactatcgcagtgcctttgatactgaagagcttgaatgaactagaggtaggcggaatgtgacaagtagcggtgaaatgcatagatatgtcacagaacaccaattgcgaaggcagcttactagggttttattgacactgaggcacgaaagcgtggggagcaaacagg

SEQ ID NO: 2290 - DNA, 253 bp, Unknown
  Description of Unknown: Bacterium polynucleotide
  OTU_86; Phylum: Bacteroidetes; Class: Sphingobacteriia; Order: Sphingobacteriales; Family: Sphingobacteriaceae
tacggaggatccaagcgttatccggatttattgggtttaaagggtgcgtaggcggctttttaagtcaggggtgaaagacggtagctcaactatcgcagtgcccttgatactgaagagcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacagg

SEQ ID NO: 2291 - DNA, 253 bp, Unknown
  Description of Unknown: Bacterium polynucleotide
  OTU_406; Phylum: Bacteroidetes; Class: Sphingobacteriia; Order: Sphingobacteriales; Family: Sphingobacteriaceae
gacgtaggatgcgagcgttatccggatttattgggtttaaagggtgcgtaggcggcctgttaagtcaggggtgaaagacggtagctcaactatcgcagtgcccttgatactgatgggcttgaatgtactagaggtaggcggaatgtgacaagtagcggtgaaatgcatagatatgtcacagaacaccaattgcgaaggcagcttactatggtattattgacgctgaggcacgaaagcgtggggatcaaacagg

SEQ ID NO: 2292 - DNA, 253 bp, Unknown
  Description of Unknown: Bacterium polynucleotide
  OTU_129; Phylum: Bacteroidetes; Class: Sphingobacteriia; Order: Sphingobacteriales; Family: Sphingobacteriaceae
tacggaggatccaagcgttatccggatttattgggtttaaagggtgcgtaggtggttctttaagtcaggggtgaaagacggcagcttaactgtcgcagtgcctttgatactgaagaacttgaatacactagaggtaggcggaatgtgacaagtagcggtgaaatgcatagatatgtcacagaacaccaattgcgaaggcagcttactatggtgtcattgacactgaggcacgaaagcgtggggatcaaacagg

SEQ ID NO: 2293 - DNA, 253 bp, Unknown
  Description of Unknown: Bacterium polynucleotide
  OTU_2892; Phylum: Bacteroidetes; Class: Sphingobacteriia; Order: Sphingobacteriales; Family: Sphingobacteriaceae
tacggaggatccaagcgttatccggatttattgggtttaaagggtgcgtaggcggcctattaagtcaggggtgaaagacggtagcttaactatcgcagtgcctttgatactgacgggcttgaatggactagaggtaggcggaatgtgacaagtagcggtgaaatgcatagatatgtcacagaacaccaattgcgaaggcagcttactatggtttaattgacgctgaggcacgaaagcgtggggatcaaacagg

SEQ ID NO: 2294 - DNA, 253 bp, Unknown
  Description of Unknown: Bacterium polynucleotide
  OTU_3722; Phylum: Bacteroidetes; Class: Sphingobacteriia; Order: Sphingobacteriales; Family: Sphingobacteriaceae
tacggaggatccaagcgttatccggatttattgggcttaaagggtgcgtaggcggcctgttaagtcaggggtgaaagacggtagcttaactatcgcagtgcccttgatactgatgggcttgaatgtactagaggtaggcggaatgtgacaagtagcggtgaaatgcatagatatgtcacagaacaccaattgcgaaggcagcttactatggtatgattgacgctgagacacgaaagcgtgggtagcaaacagg

SEQ ID NO: 2295 - DNA, 253 bp, Unknown
  Description of Unknown: Bacterium polynucleotide
  OTU_191; Phylum: Bacteroidetes; Class: Sphingobacteriia; Order: Sphingobacteriales
tacggaggatccaagcgttatccggattcattgggtttaaagggtgcgtaggcggaatgataagtcagtggtgaaagcctgcagcttaactgcagaactgccattgatactgtcaatcttgagtacatttgatgtgggcggaatgtgtcatgtagcggtgaaatgcttagatatgacacagaacaccgattgcgaaggcagctcacaaaactgtaactgacgctgaggcacgaaagcgtgggtatcaaacagg

SEQ ID NO: 2296 - DNA, 253 bp, Candidatus Protochlamydia
  OTU_223; Phylum: Chlamydiae; Class: Chlamydiia; Order: Chlamydiales; Family: Parachlamydiaceae
tacggagggtgcaagcattaatcggatttattgggcgtaaagggcgcgtaggcggggatataagtcagatgtgaaatcctggggctcaacctcagaactgcatttgaaactgtatctctagagggtaggaggagaaaacggaattccacaagtagcggtgaaatgcgtagatatgtggaagaacaccggtggcgaaggcggttttctatcttattcctgacgctgaggcgcgaaagcaaggggatcaaacagg

SEQ ID NO: 2297 - DNA, 253 bp, Unknown
  Description of Unknown: Bacterium polynucleotide
  OTU_195; Phylum: Chlamydiae; Class: Chlamydiia; Order: Chlamydiales
tacggagggtgcaagcattgatcggaattactgggcgtaaagggcgcgtaggcggcctgaaaagtcagatgtgaaattccggggctcaaccccggagctgcatttgaaactttcaggcttgaggttagtaagggaaaacggaattccacgtgtagcggtgaaatgcgtagatatgtggaagaacaccggtggtgaagacggttttctgtgctaaacctgacgctgaggcgcgaaagctaggggagcaaacagg

SEQ ID NO: 2298 - DNA, 253 bp, Unknown
  Description of Unknown: Bacterium polynucleotide
  OTU_790; Phylum: Chloroflexi; Class: Anaerolineae; Order: SBR1031; Family: A4b
aacgtaggagacgaacgttatccggagttactgggcgtaaagggcgtgtaggcggtttgttaagtctggcgtgaaagctctcggctaaaccgggagaggtcgttggatactggcaaactagaggatggtagaggcgtgtggaattccgggagtagtggtgaaatgcgtagagatccggaggaacaccagtggcgaaggcgacacgctgggccatacctgacgctaaagcgcgacagcatggggagcaaacggg

SEQ ID NO: 2299 - DNA, 253 bp, Unknown
  Description of Unknown: Bacterium polynucleotide
  OTU_103; Phylum: Fibrobacteres; Class: Fibrobacteria; Order: 258ds10
tacgaggggggcaaatgttgttcggaatcactgggcgtaaagggagcgtaggcgggttcttaagttaggtgtttaatcccggggcccaaccccggaccggcacttaaaactgggaatcttgaatagtggagaggtcggtggaattgggggtgtagcggtggaatgcgtagagatccccaagaacaccagttgcgaaggcggccgactggacacatattgacgctgaggctcgaaagcatggggagcaaacagg

SEQ ID NO: 2300 - DNA, 253 bp, Bacillus coagulans
  OTU_467; Phylum: Firmicutes; Class: Bacilli; Order: Bacillales; Family: Bacillaceae
tacgtaggtggcaagcgttgtccggaattattgggcgtaaagcgcgcgcaggcggcttcttaagtctgatgtgaaatcttgcggctcaaccgcaagcggtcattggaaactgggaggcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 2301 - DNA, 253 bp, Bacillus firmus
  OTU_3; Phylum: Firmicutes; Class: Bacilli; Order: Bacillales; Family: Bacillaceae
tacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 2302 - DNA, 253 bp, Bacillus flexus
  OTU_27; Phylum: Firmicutes; Class: Bacilli; Order: Bacillales; Family: Bacillaceae
tacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacagg

SEQ ID NO: 2303 - DNA, 253 bp, Bacillus sp.
  OTU_3473; Phylum: Firmicutes; Class: Bacilli; Order: Bacillales; Family: Bacillaceae
tacgtaggtggcaagcgttgtccggaattattgggcgtaaagcgcgcgcaggcggttccttaagtctgatgtgaaagcccacggctcaaccgttgggggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 2304 - DNA, 253 bp, Bacillus sp.
  OTU_131; Phylum: Firmicutes; Class: Bacilli; Order: Bacillales; Family: Bacillaceae
tacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacagg

SEQ ID NO: 2305 - DNA, 253 bp, Geobacillus sp.
  OTU_106; Phylum: Firmicutes; Class: Bacilli; Order: Bacillales; Family: Bacillaceae
tacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcacctgacgctgaggcgcgaaagcgtggggagcaaacagg

SEQ ID NO: 2306 - DNA, 252 bp, Paenibacillus sp.
  OTU_6; Phylum: Firmicutes; Class: Bacilli; Order: Bacillales; Family: Paenibacillaceae
tacgtagggggcaagcgttgtccggaattattgggcgtaaagcgcgcgcaggcggctttttaagtccggtgtcacagcccaaggctcaaccttgggtcgcactggaaactggagagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 2307 - DNA, 253 bp, Unknown
  Description of Unknown: Bacterium polynucleotide
  OTU_38; Phylum: Firmicutes; Class: Bacilli; Order: Bacillales; Family: Planococcaceae
tacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacagg

SEQ ID NO: 2308 - DNA, 253 bp, Unknown
  Description of Unknown: Bacterium polynucleotide
  OTU_763; Phylum: Firmicutes; Class: Bacilli; Order: Bacillales
tacgtaggtggcaagcgttgtccggaattattgggcgtaaagcgcgcgcaggcggcctcctaagtccgatgtgaaagcccacggctcaaccgtggagggtcattggaaactgggggacttgagtgcaggagagaagagtggaattccacgtgtagcggtgaaatgcgtagagatgtggaggaacaccagtggcgaaggcgactctttggcctgtaactgacgctgaggcgcgaaagcgtggggagcaaacagg

SEQ ID NO: 2309 - DNA, 253 bp, Clostridium butyricum
  OTU_9; Phylum: Firmicutes; Class: Clostridia; Order: Clostridiales; Family: Clostridiaceae
tacgtaggtggcaagcgttgtccggatttactgggcgtaaagggagcgtaggtggatatttaagtgggatgtgaaatactcgggcttaacttgagtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 2310 - DNA, 252 bp, Unknown
  Description of Unknown: SMB53 polynucleotide
  OTU_1079; Phylum: Firmicutes; Class: Clostridia; Order: Clostridiales; Family: Clostridiaceae
cacgtagggcgcgagcgttaatcggaattactgggcgtaaagggtgcgtaggtggtttcttaagtcagaggtgaaaggctacggctcaaccgtagtaagcctttgaaactgggaaacttgagtgcaggagaggagagtggaattcctagtgtagcggtgaaatgcgtagatattaggaggaacaccagttgcgaaggcggctctctggactgtaactgacactgaggcacgaaagcgtggggagcaaacagg

SEQ ID NO: 2311 - DNA, 253 bp, Thermoanaerobacterium saccharolyticum
  OTU_181; Phylum: Firmicutes; Class: Clostridia; Order: Clostridiales; Family: Clostridiaceae
tacgtagggggcgagcgttgtccggaattactgggcgtaaagagcacgtaggcggctatataagtcaggtgtgaaaaacctgggcttaaccgagggtatgcatctgaaactatatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacagg

SEQ ID NO: 2312 - DNA, 253 bp, Caldicellulosiruptor saccharolyticus
  OTU_262; Phylum: Firmicutes; Class: Clostridia; Order: Thermoanaerobacterales; Family: Caldicellulosiruptoraceae
tacgtaggtggcgagcgttgtccggaattactgggcgtaaagggtgcgtaggcggcctggtaagttgagcgtgaaatttttgggctcaacccaaaaggagcgctcaatactgccgggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacagg

SEQ ID NO: 2313 - DNA, 253 bp, Carboxydocella sp.
  OTU_431; Phylum: Firmicutes; Class: Clostridia; Order: Thermoanaerobacterales; Family: Carboxydocellaceae
aacgtagggggcgagcgttatccggaattactgggcgtaaagcgcgtgtaggcgggctgttaagtcggttgtgaaaatccggggctcaactccggacatgcagccgatactgacagtcttgagggcaggagagggaagcggaattcccggtgtagcggtgaaatgcgtagatatcgggaggaacaccagtggcgaaggcggctttctggactgtacctgacgctgagacgcgaaagcgtggggagcaaacagg

SEQ ID NO: 2314 - DNA, 253 bp, Asticcacaulis biprosthecium
  OTU_158; Phylum: Proteobacteria; Class: Alphaproteobacteria; Order: Caulobacterales; Family: Caulobacteraceae
tacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcatgactgacgctgaggctcgaaagcgtggggagcaaacagg

SEQ ID NO: 2315 - DNA, 253 bp, Caulobacter sp.
  OTU_340; Phylum: Proteobacteria; Class: Alphaproteobacteria; Order: Caulobacterales; Family: Caulobacteraceae
tacgaagggggctagcgttgctcggaattactgggcgtaaagggagcgtaggcggatagtttagtcagaggtgaaagcccagggctcaaccttggaattgcctttgatactggctatcttgagtatggaagaggtatgtggaactccgagtgtagaggtgaaattcgtagatattcggaagaacaccagtggcgaaggcgacatactggtccattactgacgctgaggctcgaaagcgtggggagcaaacagg

SEQ ID NO: 2316 - DNA, 253 bp, Caulobacter sp.
  OTU_157; Phylum: Proteobacteria; Class: Alphaproteobacteria; Order: Caulobacterales; Family: Caulobacteraceae
tacgaagggggctagcgttgctcggaattactgggcgtaaagggagcgtaggcggactgttaagttagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacagg

SEQ ID NO: 2317 - DNA, 253 bp, Mycoplana sp.
  OTU_243; Phylum: Proteobacteria; Class: Alphaproteobacteria; Order: Caulobacterales; Family: Caulobacteraceae
tacgaagggggctagcgttgctcggaattactgggcgtaaagggagcgtaggcggacatttaagtcagaggtgaaatcccggagcttaacttcggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacagg

SEQ ID NO: 2318 - DNA, 253 bp, Phenylobacterium sp.
  OTU_292; Phylum: Proteobacteria; Class: Alphaproteobacteria; Order: Caulobacterales; Family: Caulobacteraceae
tacgaagggggctagcgttgctcggaattactgggcgtaaagggcgcgtaggcggacagtttagtcagaggtgaaagcccagggctcaaccttggaattgcctttgatactggctgtcttgagttcgggagaggtgagtggaatgccgagtgtagaggtgaaattcgtagatattcggcggaacaccagtggcgaaggcgactcactggcccgatactgacgctgaggcgcgaaagcgtggggagcaaacagg

SEQ ID NO: 2319 - DNA, 253 bp, Unknown
  Description of Unknown: Bacterium polynucleotide
  OTU_341; Phylum: Proteobacteria; Class: Alphaproteobacteria; Order: Ellin329
tacgaagggggctagcgttgttcggaattactgggcgtaaagcgcgcgcaggcggtcttccaagtcagtggtgaaagcccggagctcaactccggaactgccattgaaactgttggacttgagtatgagagaggtgagtggaattcccagtgtagaggtgaaattcgtagatattgggaagaacaccggtggcgaaggcggctcactggctcattactgacgctcaggcgcgacagcgtggggatcaaacagg

SEQ ID NO: 2320 - DNA, 253 bp, Methylobacterium sp.
  OTU_69; Phylum: Proteobacteria; Class: Alphaproteobacteria; Order: Rhizobiales; Family: Methylobacteriaceae
tacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacagg

SEQ ID NO: 2321 - DNA, 253 bp, Mesorhizobium sp.
  OTU_149; Phylum: Proteobacteria; Class: Alphaproteobacteria; Order: Rhizobiales; Family: Phyllobacteriaceae
tacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacagg

SEQ ID NO: 2322 - DNA, 253 bp, Agrobacterium sp.
  OTU_54; Phylum: Proteobacteria; Class: Alphaproteobacteria; Order: Rhizobiales; Family: Rhizobiaceae
tacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 2323 - DNA, 253 bp, Agrobacterium sp.
  OTU_3736; Phylum: Proteobacteria; Class: Alphaproteobacteria; Order: Rhizobiales; Family: Rhizobiaceae
tacgaagggggctagcgttgttcggatttactgggcgtaaagcgcacgtaggcggacacttaagtcaggggtgaaatcccagagctcaactctggaactgcctttgatactgggtgtttggagtatggaagaggtaagtggaattccgagtgtagaggtgaaattcgtagatattcggaggaacaccagtggcgaaggcggcttactggtccattactgacgctgaggtgcgaaagcgtggggagcaaacagg

SEQ ID NO: 2324 - DNA, 253 bp, Rhizobium sp.
  OTU_174; Phylum: Proteobacteria; Class: Alphaproteobacteria; Order: Rhizobiales; Family: Rhizobiaceae
tacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 2325 - DNA, 253 bp, Skermanella sp.
  OTU_3518; Phylum: Proteobacteria; Class: Alphaproteobacteria; Order: Rhodospirillales; Family: Rhodospirillaceae
tacgaaggaggctagcgttgttcggaattactgggcgtaaagggcgcgtaggcggtccctcaagtcaggcgtgaaagccccgggctcaacctgggaaccgcgcttgagactgatgggctagagttcgggagaggatggtggaattcccagtgtagaggtgaaattcgtagatattggaaagaacaccgatggcgaaggcagccatctggaccgacactgacgctgaggcgcgaaagcgtggggagcaaacagg

SEQ ID NO: 2326 - DNA, 253 bp, Unknown
  Description of Unknown: Bacterium polynucleotide
  OTU_245; Phylum: Proteobacteria; Class: Alphaproteobacteria; Order: Rhodospirillales; Family: Rhodospirillaceae
tacgaagggggcgagcgttgttcggaattactgggcgtaaagggcgcgtaggcggcgacccaagtcagatgtgaaagtcctgggcttaacctggggactgcatttgatactgggttgcttgaattcgggagaggatagcggaattcccagtgtagaggtgaaattcgtagatattgggaagaacaccggtggcgaaggcggctatctggaccgacattgacgctgaggcgcgaaagcgtggggagcaaacagg

SEQ ID NO: 2327 - DNA, 253 bp, Unknown
  Description of Unknown: Bacterium polynucleotide
  OTU_289; Phylum: Proteobacteria; Class: Alphaproteobacteria; Order: Rhodospirillales; Family: Rhodospirillaceae
tacgaagggggcaagcgttgttcggaattactgggcgtaaagggcgcgtaggcggcttatcaagtcaggcgtgaaattcccgggctcaacctgggggctgcgcttgatactgatgagcttgaatgcgggagaggatagtggaattcccagtgtagaggtgaaattcgtagatattgggaagaacaccggtggcgaaggcggctatctggcccgtaattgacgctgaggcgcgaaagcgtggggagcaaacagg

SEQ ID NO: 2328 - DNA, 253 bp, Unknown
  Description of Unknown: Bacterium polynucleotide
  OTU_242; Phylum: Proteobacteria; Class: Alphaproteobacteria; Order: Rickettsiales
gacggagggggctagcgttgttcggaatgactgggcgtaaagggcgcgtaggcggttttttaagtgaggcgtgaaagccctgggcttaacctaggaggtgcgtttcatactggaagacttgagtacgagagaggaaagcggaattcctagtgtagaggtgaaattcgtagatattaggaagaacaccagtggcgaaggcggctttctggctcgtaactgacgctgaggcgcgaaagcgtggggagcaaacagg

SEQ ID NO: 2329 - DNA, 253 bp, Unknown
  Description of Unknown: Bacterium polynucleotide
  OTU_185; Phylum: Proteobacteria; Class: Alphaproteobacteria; Order: Sphingomonadales; Family: Erythrobacteraceae
tacggagggagctagcgttgttcggaaatactgggcgtaaagcgcacgtaggcggcgcagcaagtcaggggtgaaatcccggggctcaaccccggaactgcctctgaaactgcagtgctagaatcttggagaggcgagtggaattccgagtgtagaggtgaaattcgtagatattcggaagaacaccagtggcgaaggcgactcgctggacaagtattgacgctgaggtgcgaaagcgtggggagcaaacagg

SEQ ID NO: 2330 - DNA, 253 bp, Kaistobacter sp.
  OTU_184; Phylum: Proteobacteria; Class: Alphaproteobacteria; Order: Sphingomonadales; Family: Sphingomonadaceae
tacggagggggctagcgttgttcggaattactgggcgtaaagcgcacgtaggcggctttgtaagttagaggtgaaagcccggggctcaactccggaattgcctttaagactgcatcgctagaattgtggagaggtaagtggaattccgagtgtagaggtgaaattcgtagatattcggaagaacaccagtggcgaaggcgacttactggacacatattgacgctgaggtgcgaaagcgtggggagcaaacagg

SEQ ID NO: 2331 - DNA, 253 bp, Kaistobacter sp.
  OTU_304; Phylum: Proteobacteria; Class: Alphaproteobacteria; Order: Sphingomonadales; Family: Sphingomonadaceae
tacggagggggctagcgttgttcggaattactgggcgtaaagcgcacgtaggcggctttgtaagttagaggtgaaagcccggggctcaactccggaattgcctttaagactgcatcgctcgaacgtcggagaggtaagtggaattccgagtgtagaggtgaaattcgtagatattcggaagaacaccagtggcgaaggcgacttactggacgattgttgacgctgaggtgcgaaagcgtggggagcaaacagg

SEQ ID NO: 2332 - DNA, 253 bp, Sphingomonas echinoides
  OTU_568; Phylum: Proteobacteria; Class: Alphaproteobacteria; Order: Sphingomonadales; Family: Sphingomonadaceae
tacggagggagctagcgttattcggaattactgggcgtaaagcgcacgtaggcggctttgtaagtaaggggtgaaagcctggtgctcaacaccagaactgccctttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 2333 - DNA, 253 bp, Sphingomonas yabuuchiae
  OTU_23; Phylum: Proteobacteria; Class: Alphaproteobacteria; Order: Sphingomonadales; Family: Sphingomonadaceae
tacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacagg

SEQ ID NO: 2334 - DNA, 253 bp, Sphingomonas sp.
  OTU_3351; Phylum: Proteobacteria; Class: Alphaproteobacteria; Order: Sphingomonadales; Family: Sphingomonadaceae
tacggagggagctagcgttgttcggaattactgggcgtaaagcgcacgtaggcggttttgtaagtcagaggtgaaagcctggagctcaactccagaactgcctttaaaactgcatcgcttgaatccaggagaggtgagtggaattctgagtgtagaggtgaaattcgtagatattcggaagaacaccagtggcgaaggcggctcactggactggtattgacgctgaggtgcgaaagcgtggggagtaaacagg

SEQ ID NO: 2335 - DNA, 253 bp, Sphingomonas sp.
  OTU_383; Phylum: Proteobacteria; Class: Alphaproteobacteria; Order: Sphingomonadales; Family: Sphingomonadaceae
tacggagggagctagcgttgttcggaattactgggcgtaaagcgcacgtaggcggctttgtaagttaggggtgaaagcctggagctcaacttcagaattgcccttaagactgcatcgcttgaatccaggagaggtgagtggaactccgagtgtagaggtgaaattcgtagatattcggaagaacaccagtggcgaaggcggctcactggactggtattgacgctgaggtgcgaaagcgtggggagcaaacagg

SEQ ID NO: 2336 - DNA, 253 bp, Sphingomonas sp.
  OTU_78; Phylum: Proteobacteria; Class: Alphaproteobacteria; Order: Sphingomonadales; Family: Sphingomonadaceae
tacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacagg

SEQ ID NO: 2337 - DNA, 253 bp, Sphingomonas sp.
  OTU_3439; Phylum: Proteobacteria; Class: Alphaproteobacteria; Order: Sphingomonadales; Family: Sphingomonadaceae
tacggagggggctagcgttgttcggaattactgggcgtcaagcgcacctaggcggctttgtaagttagaggtgaaagcctggggctcaactctagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 2338 - DNA, 253 bp, Sphingopyxis alaskensis
  OTU_93; Phylum: Proteobacteria; Class: Alphaproteobacteria; Order: Sphingomonadales; Family: Sphingomonadaceae
tacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 2339 - DNA, 253 bp, Achromobacter sp.
  OTU_199; Phylum: Proteobacteria; Class: Betaproteobacteria; Order: Burkholderiales; Family: Alcaligenaceae
tacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacagg

SEQ ID NO: 2340 - DNA, 253 bp, Burkholderia sp.
  OTU_18; Phylum: Proteobacteria; Class: Betaproteobacteria; Order: Burkholderiales; Family: Burkholderiaceae
tacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 2341 - DNA, 253 bp, Burkholderia sp.
  OTU_639; Phylum: Proteobacteria; Class: Betaproteobacteria; Order: Burkholderiales; Family: Burkholderiaceae
tacgtagggtgcaagcgttaatcggaattactgggcgtaaagcgtgcgcaggcggtccgttaagacagatgtgaaatccccgggcttaacctgggaactgcatttgtgactggcggactcgagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 2342 - DNA, 253 bp, Burkholderia sp.
  OTU_2905; Phylum: Proteobacteria; Class: Betaproteobacteria; Order: Burkholderiales; Family: Burkholderiaceae
tacgtagggtgcgagcgttaattggaattactgggcgtaaagcgtgcgcaggcggtctgttaagaccgatgtgaaatccccgggcttaacctgggaactgcattggtgactggcaggctagagtgtggcagagggaggtagaattccacgtgtagcagtgaaatgcgtagagatgtggaggaataccgatggcgaaggcagcctcctgggccaacactgacgctcatgcacgaaagcgtggggagcaaacagg

SEQ ID NO: 2343 - DNA, 253 bp, Delftia sp.
  OTU_64; Phylum: Proteobacteria; Class: Betaproteobacteria; Order: Burkholderiales; Family: Comamonadaceae
tacgtagggtgcgagcgttaatcggaattactgggcgtaaagcgtgcgcaggcggttatgtaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 2344 - DNA, 253 bp, Hylemonella sp.
  OTU_283; Phylum: Proteobacteria; Class: Betaproteobacteria; Order: Burkholderiales; Family: Comamonadaceae
tacgtagggtgcaagcgttaatcggaattactgggcgtaaagcgtgcgcaggcggtgatgtaagacagttgtgaaatccccgggctcaacctgggaactgcatctgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 2345 - DNA, 253 bp, Methylibium sp.
  OTU_215; Phylum: Proteobacteria; Class: Betaproteobacteria; Order: Burkholderiales; Family: Comamonadaceae
tacgtagggtgcaagcgttaatcggaattactgggcgtaaagcgtgcgcaggcggctttgcaagacagatgtgaaatccccgggcttaacctgggaactgcatttgtgactgcatggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 2346 - DNA, 253 bp, Polaromonas sp.
  OTU_3641; Phylum: Proteobacteria; Class: Betaproteobacteria; Order: Burkholderiales; Family: Comamonadaceae
tacgtagggtgcgagcgttaatcggaattactgggcgtaaagcgtgcgcaggcggttatataagacagttgtgaaatccccggggtcaacctgggaattgcatctgtgactgtatagctagagtacggtagagggggatggaattccgcgagtagcagtgaaatgcgtagatatgcggaggaacaccgatggcgaaggcagtcccctggacctgtactgacgctcatgcacgaaagcgtggggagcaaacagg

SEQ ID NO: 2347 - DNA, 253 bp, Variovorax paradoxus
  OTU_3253; Phylum: Proteobacteria; Class: Betaproteobacteria; Order: Burkholderiales; Family: Comamonadaceae
tacgtagggcgcaagcgttaatcggaattactgggcgtaaagcgtgcgcaggcggttatgtaagacagttgtgaaatccccgggctcaacctgggaactgcatctgtgactgcatagctagagtacggtagagggggatggaattccgcgagtagtagtgaaatgcgtagatatgcggaggaacaccgatggcgaaggcaatcccctggacctgtactgatgctcatgcacgaaagcgtggggagcaaacagg

SEQ ID NO: 2348 - DNA, 253 bp, Variovorax sp.
  OTU_3420; Phylum: Proteobacteria; Class: Betaproteobacteria; Order: Burkholderiales; Family: Comamonadaceae
tacggaggatccaagcgttaatcggaattactgggcgtaaagcgtgcgcaggcggtgatgtaagacagatgtgaaacccccgggctcaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 2349 - DNA, 253 bp, Unknown
  Description of Unknown: Bacterium polynucleotide
  OTU_236; Phylum: Proteobacteria; Class: Betaproteobacteria; Order: Burkholderiales; Family: Comamonadaceae
tacgtagggtgcgagcgttaatcggaattactgggcgtaaagcgtgcgcaggcggctttgcaagacagaggtgaaatccccgggctcaacctgggaactgcctttgtgactgcaaggctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 2350 - DNA, 253 bp, Unknown
  Description of Unknown: Bacterium polynucleotide
  OTU_222; Phylum: Proteobacteria; Class: Betaproteobacteria; Order: Burkholderiales; Family: Comamonadaceae
tacgtagggtgcaagcgttaatcggaattactgggcgtaaagcgtgcgcaggcggttctataagacagatgtgaaatccccgggctcaacctgggaactgcatttgtgactgtagagctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 2351 - DNA, 253 bp, Unknown
  Description of Unknown: Bacterium polynucleotide
  OTU_2922; Phylum: Proteobacteria; Class: Betaproteobacteria; Order: Burkholderiales; Family: Comamonadaceae
tacgtagggtgcaagcgttaatcggaattactgggcgtaaagcgtgcgcaggcggtgatgtaagacaggtgtgaaatccccgggcttaacctgggaactgcatttgtgactgcatcgctggagtgcggcagagggggatggaattccgcgtgtagcagtgaaatgcgtagatatgcggaggaacaccgatggcgaaggcaattttctgggcctgcactgacgctcatgcacgaaagcgtggggagcaaacagg

SEQ ID NO: 2352 - DNA, 253 bp, Unknown
  Description of Unknown: Bacterium polynucleotide
  OTU_3580; Phylum: Proteobacteria; Class: Betaproteobacteria; Order: Burkholderiales; Family: Comamonadaceae
tacgtagggtgcaagcgttaatcggaattactgggcgtaaagcgtgcgcaggcggttatgcaagacagaggtgaaatccccggggtcaacctgggaactgcctttgtgactgcatagctagagtgcggcagagggggatggaattccgcgagtagcagtgaaatgcgtagatatgcggaggaacaccgatggcgaaggcaatcccctgggcctgcactgacgctcatgcacgaaagcgtggggagcaaacagg

SEQ ID NO: 2353 - DNA, 253 bp, Unknown
  Description of Unknown: Bacterium polynucleotide
  OTU_443; Phylum: Proteobacteria; Class: Betaproteobacteria; Order: Burkholderiales; Family: Comamonadaceae
tacgtagggtgcaagcgttaatcggaattactgggcgtaaagcgtgcgcaggcggtcttgtaagacagaggtgaaatccccgggcttaacctgggaactgcctttgtgactgcaaggcttgagtgcggcagagggggatggaattccgcgtgtagcagtgaaatgcgtagatatgcggaggaacaccgatggcgaaggcaatcccctgggcctgcactgacgctcatgcacgaaggcgtggggagcaaacagg

SEQ ID NO: 2354 - DNA, 253 bp, Unknown
  Description of Unknown: Bacterium polynucleotide
  OTU_2585; Phylum: Proteobacteria; Class: Betaproteobacteria; Order: Burkholderiales; Family: Comamonadaceae
tacgtagggtgcaagcgttaatcggaattactgggcgtaaagcgtgcgcaggcggttgtgcaagacagatgtgaaatccccgggctcaacttgggaactgcatttgtgactgcacggctagagtgcggcagagggagatggaattccgcgtgtagcagtgaaatgcgtagatatgcggaggaacaccgatggcgaaggcaatctcctgggcctgcactgacgctcatgcacgaaagcgtggggagcaaacagg

SEQ ID NO: 2355 - DNA, 253 bp, Herbaspirillum sp.
  OTU_50; Phylum: Proteobacteria; Class: Betaproteobacteria; Order: Burkholderiales; Family: Oxalobacteraceae
tacgtagggtgcaagcgttaatcggaattactgggcgtaaagcgtgcgcaggcggttgtgtaagtcagatgtgaaatccccgggctcaacctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacagg

SEQ ID NO: 2356 - DNA, 253 bp, Janthinobacterium lividum
  OTU_3392; Phylum: Proteobacteria; Class: Betaproteobacteria; Order: Burkholderiales; Family: Oxalobacteraceae
tacgtagggtgcaagcgttaatcggaattactgggcgtaaagcgtgcgcaggcggttttgtaagtctgatgtgaactccccgggctcaacctgggaattgcactggagactgcaaggctagaatctggcagaggggggtagaattccacgtgtagcagtgaaatgcgtagatatgtggaggaacaccgatggcgaaggcagccccctgggtcaagattgacgctcatgcacgaaagcgtggggagcaaacagg

SEQ ID NO: 2357 - DNA, 253 bp, Janthinobacterium sp.
  OTU_156; Phylum: Proteobacteria; Class: Betaproteobacteria; Order: Burkholderiales; Family: Oxalobacteraceae
tacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 2358 - DNA, 253 bp, Janthinobacterium sp.
  OTU_3582; Phylum: Proteobacteria; Class: Betaproteobacteria; Order: Burkholderiales; Family: Oxalobacteraceae
tacgtagggtgcaagcgttaatcggaattactgggcgtaaagcgtgcgcgggcggttttgtaggtctgtcgtgaaatccccgggctcaacctgggaattgcggtggggactgcaaggctagaatctggcagagggggggagaattccacgtgtagcagtgaaatgcgtagagatgtggaggaacaccgatggcgaaggcagccccctgggtcaagattgacgctcatgcacgaaagcgtggggagcaaacagg

SEQ ID NO: 2359 - DNA, 253 bp, Janthinobacterium sp.
  OTU_315; Phylum: Proteobacteria; Class: Betaproteobacteria; Order: Burkholderiales; Family: Oxalobacteraceae
tacgtagggtgcaagcgttaatcggaattactgggcgtaaagcgtgcgcaggcggttttgtaagtttgtcgtgaaatccccgggctcaacctgggaatggcgatgaagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 2360 - DNA, 253 bp, Janthinobacterium sp.
  OTU_2266; Phylum: Proteobacteria; Class: Betaproteobacteria; Order: Burkholderiales; Family: Oxalobacteraceae
tacgaggggggcaagtgttgttcggaattactgggcgtaaagcgtgcgcaggcggttttgtaagtctgtcgtgaaatccccgggctcaacctgggaattgcgatggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 2361 - DNA, 253 bp, Massilia haematophila
  OTU_2954; Phylum: Proteobacteria; Class: Betaproteobacteria; Order: Burkholderiales; Family: Oxalobacteraceae
gacggggggggcaagtgttaatcggaattactgggcgtaaagcgtgcgcaggcggttttgtaagtctgacgtgaaagccccgggctcaacctgggaattgcgttggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 2362 - DNA, 253 bp, Massilia sp.
  OTU_2344; Phylum: Proteobacteria; Class: Betaproteobacteria; Order: Burkholderiales; Family: Oxalobacteraceae
tacgtagggtgcaagcgttaatcggaattactgggcgtaaagcgtgcgcaggcggttttgtaagtctgtcgtgaaagccccgggcttaacctgtgaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggggcaaacagg

SEQ ID NO: 2363 - DNA, 253 bp, Ralstonia sp.
  OTU_58; Phylum: Proteobacteria; Class: Betaproteobacteria; Order: Burkholderiales; Family: Oxalobacteraceae
tacgtagggtccaagcgttaatcggaattactgggcgtaaagcgtgcgcaggcggttgtgcaagaccgatgtgaaatccccgggcttaacctgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 2364 - DNA, 253 bp, Unknown
  Description of Unknown: Bacterium polynucleotide
  OTU_15; Phylum: Proteobacteria; Class: Betaproteobacteria; Order: Burkholderiales; Family: Oxalobacteraceae
tacgtagggtgcaagcgttaatcggaattactgggcgtaaagcgtgcgcaggcggttttgtaagtctgacgtgaaatccccgggctcaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 2365 - DNA, 253 bp, Unknown
  Description of Unknown: Bacterium polynucleotide
  OTU_221; Phylum: Proteobacteria; Class: Betaproteobacteria; Order: Burkholderiales; Family: Oxalobacteraceae
tacgtagggtgcaagcgttaatcggaattactgggcgtaaagcgtgcgcaggcggtttggtaagacagatgtgaaatccccgggcttaacctgggaattgcatttgtgactgcccggctagagtttggcagaggggggtagaattccacgtgtagcagtgaaatgcgtagatatgtggaggaataccgatggcgaaggcagccccctgggtcaagactgacgctcatgcacgaaagcgtggggagcaaacagg

SEQ ID NO: 2366 - DNA, 253 bp, Unknown
  Description of Unknown: Bacterium polynucleotide
  OTU_2199; Phylum: Proteobacteria; Class: Betaproteobacteria; Order: Burkholderiales; Family: Oxalobacteraceae
tacgtagggtgcaagcgttaatcggaattactgggcgtaaagcgtgcgcaggcggttttgtaagtctgtcgtgaaatccccgggctcaacctgggaattgcgatggagactgcaaggctagaatatgtcagaggggggtagaattccacgtgtagcagtgaaatgcgtagagatgtggaggaataccaatggcgaaggcagccccctgggtcaagactgacgctcatgcacgaaagcgtggggagcaaacagg

SEQ ID NO: 2367 - DNA, 253 bp, Unknown
  Description of Unknown: Bacterium polynucleotide
  OTU_1776; Phylum: Proteobacteria; Class: Betaproteobacteria; Order: Ellin6067
tacgtagggtgcaagcgttaatcggaattactgggcgtaaagcgtgcgcaggcggttttgtaagccagatgtgaaatccccgggcttaacctgggaatggcatttgggactgcaaggctggagtttggcagaggagactggaattcctggtgtagcagtgaaatgcgtagatatcaggaggaataccgatggcgaaggcaggtctctgggctataactgacgctcatgcacgaaagcgtggggagcaaacagg

SEQ ID NO: 2368 - DNA, 253 bp, Unknown
  Description of Unknown: Bacterium polynucleotide
  OTU_507; Phylum: Proteobacteria; Class: Betaproteobacteria; Order: Ellin6067
tacgtagggtgcgagcgttaatcggaattactgggcgtaaagcgtgcgcaggcggttttgtaagccagatgtgaaagccccgggcttaacctgggaatggcatttgggactgcaaggcttgagtgcggcagaggagactggaattcctggtgtagcagtgaaatgcgtagatatcaggaggaataccgatggcgaaggcaggtctctgggctgacactgacgctcatgcacgaaagcgtggggagcaaacagg

SEQ ID NO: 2369 - DNA, 253 bp, Methylotenera mobilis
  OTU_176; Phylum: Proteobacteria; Class: Betaproteobacteria; Order: Methylophilales; Family: Methylophilaceae
tacgtagggtgcgagcgttaatcggaattactgggcgtaaagcgtgcgcaggctgttctgtaagtcagatgtgaaatccccgagctcaacttgggaactgcgtttgaaactacaggactagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 2370 - DNA, 253 bp, Unknown
  Description of Unknown: Bacterium polynucleotide
  OTU_115; Phylum: Proteobacteria; Class: Deltaproteobacteria; Order: Myxococcales
gacagagggtgcaaacgttgttcggaattactgggcgtaaagcgcgtgtaggcggctctgcaagtcggatgtgaaatcccacggctcaaccatggaagtgcattcgaaactgcagggctagagtcctggagaggaaggtggaatgcttggtgtagaggtgaaattcgtagatatcaagcggaacaccggtggcgaaggcggccttctggacagtgactgacgctgagacgcgaaagcgtggggagcaaacagg

SEQ ID NO: 2371 - DNA, 252 bp, Unknown
  Description of Unknown: Bacterium polynucleotide
  OTU_3227; Phylum: Proteobacteria; Class: Deltaproteobacteria; Order: Myxococcales
gacagagggtgcaaacgttgttcggaattactgggcgtaaagcgcgtgtaggcggcttcgcaagtcgggtgtgaaatcccacggctcaaccgtggaagtgcactcgagactgcaaggctagagtcctggagaggaaggtggaatgcttggtgtagaggtgaaattcgtagatatcaagcggaacaccggtggcgaaggcggccttctggacagtgactgacgctgagacgcgaaagcgtgggagcaaacagg

SEQ ID NO: 2372 - DNA, 253 bp, Unknown
  Description of Unknown: Bacterium polynucleotide
  OTU_165; Phylum: Proteobacteria; Class: Deltaproteobacteria; Order: Syntrophobacterales; Family: Syntrophobacteraceae
gacggagggtgcaagcgttgttcggattgactgggcgtaaagggcgtgtaggcggttgcccaagtccgatgtgaaagcccgaggcctaccctcggaagtgcatcggaaactaggcagctggagcgcgatagaggagggtagaattcctggagtagcggtgaaatgcgtagatatcaggaggaataccggcggcgaaggcggccctctggatcgttgctgacgctgagacgcgaaagcgtggggagcaaacagg

SEQ ID NO: 2373 - DNA, 253 bp, Cellvibrio sp.
  OTU_52; Phylum: Proteobacteria; Class: Gammaproteobacteria; Order: Alteromonadales; Family: Alteromonadaceae
tacggagggtgcaagcgttaatcggaattactgggcgtaaagcgcacgtaggtggtttgttaagctagctgtgaaatccccgggctcaacctgggcactgcagttagaactggcaagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 2374 - DNA, 253 bp, Unknown
  Description of Unknown: Bacterium polynucleotide
  OTU_146; Phylum: Proteobacteria; Class: Gammaproteobacteria; Order: Alteromonadales; Family: Alteromonadaceae
tacggagggtgcaagcgttaatcggaattactgggcgtaaagcgcgcgtaggcggccatttaagctagatgtgaaagcccagggcttaaccttggaactgcatttagaactggatggctagagtatggaagaggagtgtggaatttcaggtgtagcggtgaaatgcgtagagatctgaaggaacatcagtggcgaaggcgacactctggtccaatactgacgctgaggtgcgaaagcgtggggatcaaacagg

SEQ ID NO: 2375 - DNA, 253 bp, Enterobacter hormaechei
  OTU_1384; Phylum: Proteobacteria; Class: Gammaproteobacteria; Order: Enterobacteriales; Family: Enterobacteriaceae
tacgtagggtgcgagcgttaatcggaattactgggcgtaaagcgcacgcaggcggtctgtcaagtcggatgtgaaatccccgggctcaacctgggaactgcattcgaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 2376 - DNA, 253 bp, Enterobacter sp.
  OTU_35; Phylum: Proteobacteria; Class: Gammaproteobacteria; Order: Enterobacteriales; Family: Enterobacteriaceae
tacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggagtagcggtgaaatgcgtagagatctggaggaataccggtggcgaaggcggccccctggacgaagactgacgctcaggtgcgaaagcgtggggagcaaacagg

SEQ ID NO: 2377 - DNA, 254 bp, Erwinia sp.
  OTU_2912; Phylum: Proteobacteria; Class: Gammaproteobacteria; Order: Enterobacteriales; Family: Enterobacteriaceae
gacgggggggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 2378 - DNA, 253 bp, Escherichia coli
  OTU_319; Phylum: Proteobacteria; Class: Gammaproteobacteria; Order: Enterobacteriales; Family: Enterobacteriaceae
tacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgatgctcaggtgcgaaagcgtggggagcaaacagg

SEQ ID NO: 2379 - DNA, 253 bp, Pantoea agglomerans
  OTU_2; Phylum: Proteobacteria; Class: Gammaproteobacteria; Order: Enterobacteriales; Family: Enterobacteriaceae
tacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 2380 - DNA, 253 bp, Pantoea ananatis
  OTU_1255; Phylum: Proteobacteria; Class: Gammaproteobacteria; Order: Enterobacteriales; Family: Enterobacteriaceae
gacggggggggcaagtgttcttcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 2381 - DNA, 253 bp, Pantoea sp.
  OTU_3489; Phylum: Proteobacteria; Class: Gammaproteobacteria; Order: Enterobacteriales; Family: Enterobacteriaceae
tacggagggtgcaagcgttaatcggaattactgggcgtaaagcacacgcaggcggtctgttaagtcagatgtgaaatccccgggcttaacctgggaactgcatttgaaactggcaggcttgagcctcgtagaggggggtagaattccaggtgtagcggtgaaatgcgtagggatctggaggaataccggtggcgaaggcggccccctggacgaagactgacgctcaggtgcgaaagcgtggggagcgaacaac

SEQ ID NO: 2382 - DNA, 253 bp, Unknown
  Description of Unknown: Bacterium polynucleotide
  OTU_2970; Phylum: Proteobacteria; Class: Gammaproteobacteria; Order: Enterobacteriales; Family: Enterobacteriaceae
tacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatgtgggggaacaccgatggcgaaggcggccccctggacaaagactgacgctcaggtgcgaaagcgtggggagcaaacagg

SEQ ID NO: 2383 - DNA, 252 bp, Unknown
  Description of Unknown: Bacterium polynucleotide
  OTU_3078; Phylum: Proteobacteria; Class: Gammaproteobacteria; Order: Enterobacteriales; Family: Enterobacteriaceae
tacggagggtgcaagcgttaatcggaattactgggcgtaaaacgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggagtaccggtggcgaaggcggccccctggacaaagactgacgccaggtgcgaaagcgtggggagcaaacagg

SEQ ID NO: 2384 - DNA, 253 bp, Unknown
  Description of Unknown: Bacterium polynucleotide
  OTU_3153; Phylum: Proteobacteria; Class: Gammaproteobacteria; Order: Enterobacteriales; Family: Enterobacteriaceae
tacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggggaaaggaggagagatctggaggaagaccgggggcgaaggcggccccctggacaaagactgacgctcaggtgcgaaagcgtggggagcaaacagg

SEQ ID NO: 2385 - DNA, 253 bp, Aquicella sp.
  OTU_145; Phylum: Proteobacteria; Class: Gammaproteobacteria; Order: Legionellales; Family: Coxiellaceae
tacagagggtgcgagcgttaatcggagttactgggcgtaaagggcgcgtaggcggtaatatgagtgtggtgtgaaagccccgggcttaacctgggaagtgcatcgcaaacgatataactagagtagatgagagggtggcggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 2386 - DNA, 253 bp, Aquicella sp.
  OTU_379; Phylum: Proteobacteria; Class: Gammaproteobacteria; Order: Legionellales; Family: Coxiellaceae
tacagagggtgcgagcgttaatcggaattactgggcgtaaagggcgcgtaggcggttagttaagtgtgatgtgaaagccccgggcttaacctgggaagtgcatcgcaaactggttaactggagtatatgagagggtggcggaatttccggtgtagcggtgaaatgcgtagagatcggaaggaacgtcgatggcgaaggcagccacctggcataatactgacgctgatgcgcgaaagcgtggggagcgaacagg

SEQ ID NO: 2387 - DNA, 253 bp, Aquicella sp.
  OTU_390; Phylum: Proteobacteria; Class: Gammaproteobacteria; Order: Legionellales; Family: Coxiellaceae
tacagagggtgcgagcgttaatcggagttactgggcgtaaagggcgcgtaggcggatatatgagtgttatgtgaaagccctgggcttaacctgggaagtgcatagcaaacgatatatctggagtacaagagagggtggcggaatttccggtgtagcggtgaaatgcgtagagatcggaaggaacgtcgatggcgaaggcagccacctggcttgatactgacgctgaggcgcgaaagcgtggggagcgaacagg

SEQ ID NO: 2388 - DNA, 253 bp, Aquicella sp.
  OTU_209; Phylum: Proteobacteria; Class: Gammaproteobacteria; Order: Legionellales; Family: Coxiellaceae
tacagagggtgcgagcgttgatcggaattactgggcgtaaagggcgcgtaggcggttacatgagtgtgctgtgaaagccccgggcttaacctgggaagtgcagtgcaaacgatgtaactggagtagatgagagggtggtggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 2389 - DNA, 253 bp, Unknown
  Description of Unknown: Bacterium polynucleotide
  OTU_197; Phylum: Proteobacteria; Class: Gammaproteobacteria; Order: Legionellales; Family: Coxiellaceae
tacagagggtgcaagcgttaatcggatttactgggcgtaaagggcgcgtaggtggtagcgtaagtgagatgtgaaatccccgggcttaacctgggacgtgcatcttagactgcgtaacttgagtgtagtagagggtagtggaatttccggtgtagcggtgaaatgcgtagatatcggaaggaacaccagtggcgaaggcggctacctggactaacactgacactgaggcgcgagagcgtggggagcaaacagg

SEQ ID NO: 2390 - DNA, 253 bp, Haemophilus parainfluenzae
  OTU_3292; Phylum: Proteobacteria; Class: Gammaproteobacteria; Order: Pasteurellales; Family: Pasteurellaceae
tacggagggtgcgagcgttaatcggaataactgggcgtaaagggcacgcaggcggtgacttaagtgaggtgtgaaagccccgggcttaacctgggaattgcactccatactgggtcgctagagtactttagggaggggtagaattccacgtgtagcggtgaaatgcgtggagatgtggaggaataccgaaggcgaaggcagccccttgggaatgtactgacgctcatgtgcgaaagcgtggggagcaaacagg

SEQ ID NO: 2391 - DNA, 253 bp, Haemophilus sp.
  OTU_363; Phylum: Proteobacteria; Class: Gammaproteobacteria; Order: Pasteurellales; Family: Pasteurellaceae
tacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 2392 - DNA, 253 bp, Acinetobacter rhizosphaerae
  OTU_155; Phylum: Proteobacteria; Class: Gammaproteobacteria; Order: Pseudomonadales; Family: Moraxellaceae
tacagagggtgcaagcgttaatcggatttactgggcgtaaagcgcgcgtaggcggccaattaagtcaaatgtgaaatccccgagcttaacttgggaattgcattcgatactggttggctagagtgtgggagaggatggtagaattccaggtgtagcggtgaaatgcgtagagatctggaggaataccgatggcgaaggcagccatctggcctaacactgacgctgaggtgcgaaagcatggggagcaaacagg

SEQ ID NO: 2393 - DNA, 253 bp, Acinetobacter sp.
  OTU_216; Phylum: Proteobacteria; Class: Gammaproteobacteria; Order: Pseudomonadales; Family: Moraxellaceae
tacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacagg

SEQ ID NO: 2394 - DNA, 253 bp, Pseudomonas viridiflava
  OTU_2544; Phylum: Proteobacteria; Class: Gammaproteobacteria; Order: Pseudomonadales; Family: Pseudomonadaceae
tacagagggtgcaagcgttagtcggaattactgggcgtaaagcgcgcgtaggtggttcgttaagttggatgtgaaagccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacagg

SEQ ID NO: 2395 - DNA, 253 bp, Pseudomonas sp.
  OTU_11; Phylum: Proteobacteria; Class: Gammaproteobacteria; Order: Pseudomonadales; Family: Pseudomonadaceae
tacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 2396 - DNA, 253 bp, Pseudomonas sp.
  OTU_7; Phylum: Proteobacteria; Class: Gammaproteobacteria; Order: Pseudomonadales; Family: Pseudomonadaceae
tacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacagg

SEQ ID NO: 2397 - DNA, 253 bp, Pseudomonas sp.
  OTU_3276; Phylum: Proteobacteria; Class: Gammaproteobacteria; Order: Pseudomonadales; Family: Pseudomonadaceae
tacagagggtgcaagcgttaatcggaattactgggcgtaaagcgcgcgtaggtggcctggtaagttgaatgtgaaatccccgggctcaacctgggaactgcatccaaaactgcctggctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 2398 - DNA, 253 bp, Pseudomonas sp.
  OTU_3748; Phylum: Proteobacteria; Class: Gammaproteobacteria; Order: Pseudomonadales; Family: Pseudomonadaceae
tacagagggtgcgagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtaacggtgagatgcgtagatataggaaggaacaccagtggcgaaggcgaccacctggactgatactgacactgaggtgcgaaggcgtggagagcaaacagg

SEQ ID NO: 2399 - DNA, 253 bp, Pseudomonas sp.
  OTU_3228; Phylum: Proteobacteria; Class: Gammaproteobacteria; Order: Pseudomonadales; Family: Pseudomonadaceae
tacagagggtgcaagcgttaatcggaattactgggcgtaaagcgcgcgtaggtagttcgttaagttggatgtgaaagccccgggctcaacctgggaactgcattcaaaactgacgagctagagtatggtagagggtggtggaatttcctgtgtagcggtgaaatgcgtagacataggaaggaacaccagtggcgaaggcgaccacctggactgatactgacgctgaggtgcgaaagcgtggggatcaaacagg

SEQ ID NO: 2400 - DNA, 253 bp, Pseudomonas sp.
  OTU_204; Phylum: Proteobacteria; Class: Gammaproteobacteria; Order: Pseudomonadales; Family: Pseudomonadaceae
tacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 2401 - DNA, 253 bp, Pseudomonas sp.
  OTU_2653; Phylum: Proteobacteria; Class: Gammaproteobacteria; Order: Pseudomonadales; Family: Pseudomonadaceae
tacggagggggctagcgttaatcggaattactgggcgtaaagcgcgcgtaggtggttcgttaagttggatgtgaaatccccgggctcaacctggggactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 2402 - DNA, 253 bp, Arenimonas sp.
  OTU_144; Phylum: Proteobacteria; Class: Gammaproteobacteria; Order: Xanthomonadales; Family: Xanthomonadaceae
tacgaagggtgcaagcgttactcggaattactgggcgtaaagcgtgcgtaggtggttcgttaagtctgccgtgaaagccccgggctcaacctgggaatggcggtggatactggcggactagagtgcggtagagggtggtggaattcccggtgtagcagtgaaatgcgtagagatcgggaggaacatctgtggcgaaggcggccacctggaccagcactgacactgaggcacgaaagcgtggggagcaaacagg

SEQ ID NO: 2403 - DNA, 253 bp, Dokdonella sp.
  OTU_3850; Phylum: Proteobacteria; Class: Gammaproteobacteria; Order: Xanthomonadales; Family: Xanthomonadaceae
tacgaagggtgcaagcgttactcggtatcactgggcataaagcgtgcgtaggcggttcgttgagtctgctgtgaaagccctgggctcaacctgggaactgcagtggatactggcgggctagagtgtgatagaggatggtggaattcccggagtagcggtgaaatgcgtagagatcgggaggaacaccagtggcgaaggcggccatctggatcaacactgacgctgaggcacgaaagcgtggggagcaaacagg

SEQ ID NO: 2404 - DNA, 253 bp, Luteimonas sp.
  OTU_177; Phylum: Proteobacteria; Class: Gammaproteobacteria; Order: Xanthomonadales; Family: Xanthomonadaceae
tacgaagggtgcaagcgttactcggaattactgggcgtaaagcgtgcgtaggtggttcgttaagtctgatgtgaaagccctgggctcaacctgggaattgcattggatactggcgggctagagtgcggtagaggatggcggaattcccggtgtagcagtgaaatgcgtagagatcgggaggaacatctgtggcgaaggcggccatctggaccagcactgacactgaggcacgaaagcgtggggagcaaacagg

SEQ ID NO: 2405 - DNA, 253 bp, Lysobacter sp.
  OTU_194; Phylum: Proteobacteria; Class: Gammaproteobacteria; Order: Xanthomonadales; Family: Xanthomonadaceae
tacgaagggtgcaagcgttactcggaattactgggcgtaaagcgtgcgtaggtggttcgttaagtctgatgtgaaagccctgggctcaacctgggaatggcattggatactggcgacctagagtgcggtagaggggtgtggaattcccggtgtagcagtgaaatgcgtagatatcgggaggaacatctgtggcgaaggcgacaccctggaccagcactgacactgaggcacgaaagcgtggggagcaaacagg

SEQ ID NO: 2406 - DNA, 253 bp, Rhodanobacter sp.
  OTU_527; Phylum: Proteobacteria; Class: Gammaproteobacteria; Order: Xanthomonadales; Family: Xanthomonadaceae
tacgaagggtgcaagcgttaatcggaattactgggcgtaaagggtgcgtaggcggttatttaagtctgctgtgaaatccccgggctcaacctgggaatggcagtggatactggatagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 2407 - DNA, 253 bp, Rhodanobacter sp.
  OTU_168; Phylum: Proteobacteria; Class: Gammaproteobacteria; Order: Xanthomonadales; Family: Xanthomonadaceae
tacgaagggtgcaagcgttaatcggaattactgggcgtaaagggtgcgtaggcggttcgttaagtctgtcgtgaaatccccgggctcaacctgggaatggcgatggatactggcgagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 2408 - DNA, 253 bp, Stenotrophomonas sp.
  OTU_83; Phylum: Proteobacteria; Class: Gammaproteobacteria; Order: Xanthomonadales; Family: Xanthomonadaceae
tacgaagggtgcaagcgttactcggaattactgggcgtaaagcgtgcgtaggtggttatttaagtccgttgtgaaagccctgggctcaacctgggaactgcagtggatactggatgactagaatgtggtagagggtagcggaattcctggtgtagcagtgaaatgcgtagagatcaggaggaacatccatggcgaaggcagctacctggaccaacattgacactgaggcacgaaagcgtggggagcaaacagg

SEQ ID NO: 2409 - DNA, 253 bp, Stenotrophomonas sp.
  OTU_2829; Phylum: Proteobacteria; Class: Gammaproteobacteria; Order: Xanthomonadales; Family: Xanthomonadaceae
tacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacgtccatggcgaaggcatctacctggaccaacactgacactgaggcacgaaagcgtggggagcaaacggg

SEQ ID NO: 2410 - DNA, 253 bp, Xanthomonas axonopodis
  OTU_382; Phylum: Proteobacteria; Class: Gammaproteobacteria; Order: Xanthomonadales; Family: Xanthomonadaceae
tacgaagggtgcaagcgttactcggaattactgggcgtaaagcgtgcgtaggtggtggtttaagtctgttgtgaaagccctgggctcaacctgggaattgcagtggatactggatcactagagtgtggtagagggtagcggaattcccggtgtagcagtgaaatgcgtagagatcgggaggaacatccgtggcgaaggcggctacctggaccaacactgacactgaggcacgaaagcgtggggagcaaacagg

SEQ ID NO: 2411 - DNA, 253 bp, Turneriella sp.
  OTU_334; Phylum: Spirochaetes; Class: Leptospirae; Order: Leptospirales; Family: Leptospiraceae
tacgtatggggcaagcgttgttcggaattattgggcgtaaagggctcgcaggtggtttgttaagttggtggtttaatctctgggctcaacccagagtcagcctccaaaactggcgaacttgagtacgataggggatagcggaattctcggtgtagcggtggaatgcgtagatatcgagaggaacaccaatggcgaaggcagctatctggatcgtaactgacactcatgagcgaaagtgcggggagcaaacagg

SEQ ID NO: 2412 - DNA, 252 bp, Mycoplasma sp.
  OTU_89; Phylum: Tenericutes; Class: Mollicutes; Order: Mycoplasmatales; Family: Mycoplasmataceae
aacataggtcacgagcattatccggatttattgggcgtaaaggaagcgtaggcggggaggttgatccattgttaaaagcatttgcttaacaaatgtgtgcattggagatcgcctccctagagttaatcagggggtactggaattcaatgtgtagcggtggaatgcgtagatatattgaggaacaccagaggctaaggcgagtgcctaggatataactgacgctgaggcttgaaagcgtggggagcaaatggg

SEQ ID NO: 2413 - DNA, 253 bp, Unknown
  Description of Unknown: Bacterium polynucleotide
  OTU_214; Phylum: Verrucomicrobia; Class: Pedosphaerae; Order: Pedosphaerales; Family: auto67_4W
tacagaggtcccaagcgttgttcggattcactgggcgtaaagggtgcgtaggcggtcgggtaagtctgacgtgaaatcttcaagctcaacttggaaactgcgtcggatactattcggctcgaggaatggaggggagactggaatacttggtgtagcagtgaaatgcgtagatatcaagtggaacaccagtggcgaaggcgagtctctggacatttcctgacgctgaggcacgaaagccaggggagcaaacggg

SEQ ID NO: 2414 - DNA, 253 bp, Opitutus sp.
  OTU_385; Phylum: Verrucomicrobia; Class: Opitutae; Order: Opitutales; Family: Opitutaceae
tacagagactgcaagcgttattcggattcactgggcgtaaagggtgcgcaggcggccatgtgtgtgaggcgtgaaagcccgatgctcaacatcggaattgcacctcaaactacatggctagagcattggagagggtagcggaattcacggtgtagcagtgaaatgcgtagatatcgtgaggaacaccagaggcgaaggcggctacctggacaattgctgacgctcaggcacgaaagcgtggggagcaaaaggg

SEQ ID NO: 2415 - DNA, 253 bp, Opitutus sp.
  OTU_252; Phylum: Verrucomicrobia; Class: Opitutae; Order: Opitutales; Family: Opitutaceae
tacagagactgcaagcgttattcggattcactgggcgtaaagggtgcgcaggcggccgtgtgtgtcagatgtgaaatcccggggcttaactccggaactgcgtctgaaactacacggctagagcattggagagggtagtggaattcacggtgtagcagtgaaatgcgtagatatcgtgaggaacaccagaggcgaaggcgactacctggacaattgctgacgctcaggcacgaaagcgtggggagccaaaggg

SEQ ID NO: 2416 - DNA, 253 bp, Unknown
  Description of Unknown: Bacterium polynucleotide
  OTU_279; Phylum: Verrucomicrobia; Class: Opitutae; Order: Opitutales; Family: Opitutaceae
tacagagactgcaagcgttattcggattcactgggcgtaaagggtgcgcaggcggttgggtgtgtcagatgtgaaatcccgaggctcaacctcggaactgcgtctgaaactactcgactagagtactggagagggtaacggaattcacggtgtagcagtgaaatgcgtagatatcgtgaggaacaccagaggcgaaggcggttacctggacagttactgacgctcaggcacgaaagcatggggagcaaaaggg

SEQ ID NO: 2417 - DNA, 253 bp, Luteolibacter sp.
  OTU_280; Phylum: Verrucomicrobia; Class: Verrucomicrobiae; Order: Verrucomicrobiales; Family: Verrucomicrobiaceae
tacgaaggtcccaagcgttgttcggaatcactgggcgtaaagggagcgtaggcggcgtggtaagtcagatgtgaaatcccggggctcaaccccggaactgcatccgatactgccatgcttgagggttggagaggtagctggaattctcggtgtagcagtgaaatgcgtggatatcgagaggaacactcgtggcgaaggcgagctactggacaacatctgacgctgaggctcgaaggctaggggagcaaaaggg

SEQ ID NO: 2418 - DNA, 253 bp, Luteolibacter sp.
  OTU_172; Phylum: Verrucomicrobia; Class: Verrucomicrobiae; Order: Verrucomicrobiales; Family: Verrucomicrobiaceae
tacgaaggtcccgagcgttgttcggaatcactgggcgtaaagggagcgtaggcggcgcggtaagtcagatgtgaaatcccggggctcaaccccggaactgcatccgatactgccgtgctagaggattggagaggtagctggaattcttggtgtagcagtgaaatgcgtggagatcaagaggaacactcgtggcgaaagcgagctactggacaatatctgacgctgaggctcgaaggccagggtagcgaaaggg

SEQ ID NO: 2419 - DNA, 253 bp, Enterobacter sp.; identical to SEQ ID NO: 2376
  Phylum: Proteobacteria; Class: Gammaproteobacteria; Order: Enterobacteriales; Family: Enterobacteriaceae

SEQ ID NO: 2420 - DNA, 253 bp, Polaromonas sp.
  Phylum: Proteobacteria; Class: Betaproteobacteria; Order: Burkholderiales; Family: Comamonadaceae
tacgtagggtgcgagcgttaatcggaattactgggcgtaaagcgtgcgcaggcggttctataagacagatgtgaaatccccgggctcaacctgggaatggcatttgtgactgtagggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 2421 - DNA, 253 bp, Carboxydocella sp.; identical to SEQ ID NO: 2313
  Phylum: Firmicutes; Class: Clostridia; Order: Thermoanaerobacterales; Family: Carboxydocellaceae

SEQ ID NO: 2422 - DNA, 253 bp, Staphylococcus sp.
  Phylum: Firmicutes; Class: Bacilli; Order: Bacillales; Family: Staphylococcaceae
tacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 2423 - DNA, 253 bp, Thermoanaerobacterium saccharolyticum; identical to SEQ ID NO: 2311
  Phylum: Firmicutes; Class: Clostridia; Order: Clostridiales; Family: Clostridiaceae

SEQ ID NO: 2424 - DNA, 253 bp, Pantoea agglomerans; identical to SEQ ID NO: 2379
  Phylum: Proteobacteria; Class: Gammaproteobacteria; Order: Enterobacteriales; Family: Enterobacteriaceae

SEQ ID NO: 2425 - DNA, 252 bp, Paenibacillus sp.; identical to SEQ ID NO: 2306
  Phylum: Firmicutes; Class: Bacilli; Order: Bacillales; Family: Paenibacillaceae

SEQ ID NO: 2426 - DNA, 253 bp, Rhizobium sp.; identical to SEQ ID NO: 2324
  Phylum: Proteobacteria; Class: Alphaproteobacteria; Order: Rhizobiales; Family: Rhizobiaceae

SEQ ID NO: 2427 - DNA, 253 bp, Prosthecobacter sp.
  Phylum: Verrucomicrobia; Class: Verrucomicrobiae; Order: Verrucomicrobiales; Family: Verrucomicrobiaceae
tacagaggtctcaagcgttgttcggaatcactgggcgtaaagggtgcgtaggtggcgtggaaagtcagatgtgaaagcccggggctcaacctcggaattgcatccgatactaccatgctagagtactgaagaggtgactagaattctcggtgtagcagtgaaatgcgtagatatcgagaggaataccaacggcgaaggcaggtcactgggcagttactgacactgaggcacgaaggccaggggagcaaacggg

SEQ ID NO: 2428 - DNA, 253 bp, Geobacillus sp.; identical to SEQ ID NO: 2305
  Phylum: Firmicutes; Class: Bacilli; Order: Bacillales; Family: Bacillaceae

SEQ ID NO: 2429 - DNA, 253 bp, Unknown
  Description of Unknown: Bacterium polynucleotide
  Phylum: Proteobacteria; Class: Betaproteobacteria; Order: Burkholderiales; Family: Oxalobacteraceae
tacgtagggtgcgagcgttaatcggaattactgggcgtaaagcgtgcgcaggcggttgggcaagaccgatgtgaaatccccgggcttaacctgggaatggcattggtgactgctcggctagagtgtgtcagaggggggtagaattccacgtgtagcagtgaaatgcgtagagatgtggaggaataccgatggcgaaggcagccccctgggataacactgacgctcaggcacgaaagcgtggggagcaaacagg

SEQ ID NO: 2430 - DNA, 253 bp, Unknown
  Description of Unknown: Bacterium polynucleotide
  Phylum: Firmicutes; Class: Bacilli; Order: Bacillales; Family: Bacillaceae
tacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcaaaggcggcacactggtctgtaactgacgctgaggcgcgaaagcgtggggagcaaacagg

SEQ ID NO: 2431 - DNA, 253 bp, Phenylobacterium sp.
  Phylum: Proteobacteria; Class: Alphaproteobacteria; Order: Caulobacterales; Family: Caulobacteraceae
tacgaagggggctagcgttgctcggaattactgggcgtaaagggcgcgtaggcggacagtttagtcagaggtgaaagcccagggctcaaccttggaattgcctttgatactggctgtcttgagtacgggagaggtgagtggaactccgagtgtagaggtgaaattcgtagatattcggaagaacaccagtggcgaaggcgactcactggcccgttactgacgctgaggcgcgaaagcgtggggagcaaacagg

SEQ ID NO: 2432 - DNA, 253 bp, Flavobacterium succinicans
  Phylum: Bacteroidetes; Class: Flavobacteriia; Order: Flavobacteriales; Family: Flavobacteriaceae
tacggaggatccaagcgttatccggaatcattgggtttaaagggtccgtaggcggtcttgtaagtcagtggtgaaagcccatcgctcaacggtggaacggccattgatactgctggacttgaattactgggaagcaactagaatatgtagtgtagcggtgaaatgcttagagattacatggaataccaattgcgaaggcaggttgctaccagtggattgacgctgatggacgaaagcgtgggtagcgaacagg

SEQ ID NO: 2433 - DNA, 253 bp, Unknown
  Description of Unknown: Bacterium polynucleotide
  Phylum: Bacteroidetes; Class: Cytophagia; Order: Cytophagales; Family: Cytophagaceae
tacgtaggtggcaagcgttgtccggatttattgggtttaaagggtgcgtaggcggcctattaagtcagttctgaaatatcccggcttaaccgggagggtgggattgatactgatgggcttgagtggaatcgaggtaggcggaattgacggtgtagcggtgaaatgcttagatatcgtcaagaacaccgatagtgtagacagcttactagacttcaactgacgctgaggcacgaaagtgtggggatcaaacagg

SEQ ID NO: 2434 - DNA, 253 bp, Unknown
  Description of Unknown: Bacterium polynucleotide
  Phylum: Bacteroidetes; Class: Saprospirae; Order: Saprospirales; Family: Chitinophagaceae
tacggagggtgcaagcgttatccggattcactgggtttaaagggtgcgtaggcggacaggtaagtcagtggtgaaatctccgagcttaactcggaaactgccgttgatactatttgtcttgaatattgtggaggtaagcggaatatgtcatgtagcggtgaaatgcttagatatgacatagaacaccaattgcgaaggcagcttgctacacaatcattgacgctgaggcacgaaagcgtggggatcaaacagg

SEQ ID NO: 2435 - DNA, 253 bp, Escherichia coli
  Phylum: Proteobacteria; Class: Gammaproteobacteria; Order: Enterobacteriales; Family: Enterobacteriaceae
tacggagggtgcaagcgttaatcggaattactgggcgtaaagcgcacgcaggcggtttgttaagtcagatgtgaaatccccgggcccaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 2436 - DNA, 253 bp, Shinella sp.
  Phylum: Proteobacteria; Class: Alphaproteobacteria; Order: Rhizobiales; Family: Rhizobiaceae
tacgaagggggctagcgttgttcggaattactgggcgtaaagcgcacgtaggcggatatttaagtcaggggtgaaatcccggggctcaaccccggaactgcctttgatactgggtatctggagtatggaagaggtaagtggagttccgagcgtagaggtgaaatccgtagatattcggaggaacaccagtggcgaaggcggcttactggtccattactgacgctgaggtgcgaaagcgtggggagcaaacagg

SEQ ID NO: 2437 - DNA, 253 bp, Pedobacter sp.
  Phylum: Bacteroidetes; Class: Sphingobacteriia; Order: Sphingobacteriales; Family: Sphingobacteriaceae
tacggaggatccaagcgttatccggatttattgggtttaaagggtgcgtaggcggcctgttaagtcaggggtgaaagacggtagctcaactatcgcagtgcccttgatactgatgggcttgaatacactagaggtaggcggaatgtgacaagtagcggtgaaatgcatagatatgtcacagaacaccgattgcgaaggcagcttactatggtgtcattgacgctgaggcacgaaagcgtggggatcaaacagg

SEQ ID NO: 2438 - DNA, 253 bp, Luteolibacter sp.
  Phylum: Verrucomicrobia; Class: Verrucomicrobiae; Order: Verrucomicrobiales; Family: Verrucomicrobiaceae
tacgaaggtcccaagcgttgttcggaatcactgggcgtaaagggagcgtaggcggcgtggtaagtcagatgtgaaatcccggggctcaaccccggaactgcatccgatactgccatgcttgagggttggagaggtagctggaattctcggtgtagcagtgaaatgcgtggatatcgagaggaacactcgtggcgaaggcgagctactggacaacatctgacgctgaggctcgaaggccaggggagcaaaaggg

SEQ ID NO: 2439 - DNA, 253 bp, Sediminibacterium sp.
  Phylum: Bacteroidetes; Class: Saprospirae; Order: Saprospirales; Family: Chitinophagaceae
tacggagggtgcaagcgttatccggattcactgggtttaaagggtgcgtaggcgggcaggtaagtcagtggtgaaatcctagagcttaactctagaactgccattgatactatctgtcttgaatattgtggaggtaagcggaatatgtcatgtagcggtgaaatgcttagatatgacatagaacacctattgcgaaggcagcttactacgcatatattgacgctgaggcacgaaagcgtggggatcaaacagg

SEQ ID NO: 2440 - DNA, 253 bp, Unknown
  Description of Unknown: Bacterium polynucleotide
  Phylum: Firmicutes; Class: Bacilli; Order: Bacillales; Family: Staphylococcaceae
tacgtaggtggcaagcgttatccggaattattgggcgtaaagcgcgcgtaggcggtctcttaagtctgatgtgaaagcccccggctcaaccggggagggtcattggaaactgggagacttgagtgcagaagaggagagtggaattccatgtgtagcggtgaaatgcgcagagatatggaggaacaccagtggcgaaggcggctctctggtctgtaactgacgctgaggtgcgaaagcgtggggatcaaacagg

SEQ ID NO: 2441 - DNA, 253 bp, Alicyclobacillus sp.
  Phylum: Firmicutes; Class: Bacilli; Order: Bacillales; Family: Alicyclobacillaceae
tacgtagggggcaagcgttgtccggattcactgggcgtaaagcgcgcgcaggcggtgatgtaagtctgaggtgaaaacccgaagctcaacttcgggactgccttggatactgcgtcacttgaggataggagaggcaaggggaattccacgtgtagcggtgaaatgcgtagagatgtggaggaacacctgtggcgaaggcgccttgctggcctatttctgacgctgaggcgcgaaagcgtggggagcaaacagg

SEQ ID NO: 2442 - DNA, 253 bp, Unknown
  Description of Unknown: Bacterium polynucleotide
  Phylum: Verrucomicrobia; Class: Spartobacteria; Order: Chthoniobacterales; Family: Chthoniobacteraceae
tacagaggtctcaaccgttgttcggattcattgggcgtaaagggtgcgtaggcggtcgcgcaagtcggatgtgaaatctcagggctcaaccctgaaactgcattcgatactgcgtggctagagtactggagaggagactggaatttacggtgtagcagtgaaatgcgtagatatcgtaaggaagaccagtggcgaaggcgagtctctggacagtaactgacgctgaggcacgaaggccaggggagcaaacggg

SEQ ID NO: 2443 - DNA, 253 bp, Janthinobacterium sp.
  Phylum: Proteobacteria; Class: Betaproteobacteria; Order: Burkholderiales; Family: Oxalobacteraceae
tacgtagggtgcaagcgttaatcggaattactgggcgtaaagcgtgcgcaggcggttttgtaagtctgttgtgaaatccccgggcttaacctgggaatggcaatggagactgcaaggctagagtttggcagaggggggtagaattccacgtgtagcagtgaaatgcgtagagatgtggaggaacaccgatggcgaaggcagccccctgggtcaaaactgacgctcatgcacgaaagcgtggggagcaaacagg

SEQ ID NO: 2444 - DNA, 253 bp, Sediminibacterium sp.; identical to SEQ ID NO: 2261
  Phylum: Bacteroidetes; Class: Saprospirae; Order: Saprospirales; Family: Chitinophagaceae

SEQ ID NO: 2445 - DNA, 250 bp, Dyadobacter sp.
  Phylum: Bacteroidetes; Class: Cytophagia; Order: Cytophagales; Family: Cytophagaceae
tacggagggtgcgagcgttgtccggatttattgggtttaaagggtgcgtaggtggctttataagtcagtggtgaaatacggttgctcaaccgaggtgccattgatactgcaaagcttgaaataattggaggctgccggaatggatggtgtagcggtgaaatgcatagatatcatccagaacaccgattgcgaaggcaggtggctacgattggtttgacactgaggcacgaaagcatggggagcaaacagg

SEQ ID NO: 2446 - DNA, 253 bp, Unknown
  Description of Unknown: Bacterium polynucleotide
  Phylum: Proteobacteria; Class: Betaproteobacteria
tacgtagggtgcaggcgttaatcggaattactgggcgtaaagcgtgcgcaggcggtttgctaagacaggtgtgaaatccccgagcttaacttgggaattgcgcttgtaactggcaggctagagtgtagcagaggggggtggaattccacgtgtagcagtgaaatgcgtagatatgtggaggaacaccgatggcgaaggcagccccctgggttaacactgacgctcatgcacgaaagcgtggggagcaaacagg

SEQ ID NO: 2447 - DNA, 253 bp, Unknown
  Description of Unknown: Bacterium polynucleotide
  Phylum: Bacteroidetes; Class: Sphingobacteriia; Order: Sphingobacteriales; Family: Sphingobacteriaceae
tacggaggatccaagcgttatccggatttattgggtttaaagggtgcgtaggcggcctattaagtcaggggtgaaagacggtggctcaaccatcgcagtgcccttgatactgatgggcttgattacacttgaggtaggcggaatgtgacaagtagcggtgaaatgcatagatatgtcacagaacaccaattgcgaaggcagcttactaaggtgtcaatgacgctgaggcacgaaagcgtggggatcaaacagg

SEQ ID NO: 2448 - DNA, 253 bp, Flavobacterium succinicans
  Phylum: Bacteroidetes; Class: Flavobacteriia; Order: Flavobacteriales; Family: Flavobacteriaceae
tacggaggatccaagcgttatccggaatcattgggtttaaagggttcgtaggcggtcttgtaagtcagtggtgaaagcccatcgctcaacggtggaacggccattgatactgcaggacttgaattattgggaagtaactagaatatgtagtgtagcggtgaaatgcttagagattacatggaataccaattgcgaaggcaggttactaccaatttattgacgctgatggacgaaagcgtgggtagcgaacagg

SEQ ID NO: 2449 - DNA, 253 bp, Unknown
  Description of Unknown: Bacterium polynucleotide
  Phylum: Proteobacteria; Class: Betaproteobacteria; Order: Burkholderiales; Family: Alcaligenaceae
tacgtagggtgcaagcgttaatcggaattactgggcgtaaagcgtgcgcaggcggtttggaaagaaagatgtgaaatcccagagcttaactttggaactgcatttttaactgccaagctagagtatgtcagaggggggtagaattccacgtgtagcagtgaaatgcgtagagatgtggaggaataccgatggcgaaggcagccccctgggataatactgacgctcatgcacgaaagcgtggggagcaaacagg

SEQ ID NO: 2450 - DNA, 253 bp, Rubrobacter sp.
  Phylum: Actinobacteria; Class: Rubrobacteria; Order: Rubrobacterales; Family: Rubrobacteraceae
tacgtagggggcgagcgttgtccggaatcattgggcgtaaagagcgtgtaggcggcccggtaagtccgctgtgaaaacccggggctcaaccccgggcgtgcagtggaaactgccgggctagagggcggcagaggcgagtggaattcccggtgtagcggtgaaatgcgcagatatcgggaggaacaccagtagcgaaggcggctcgctgggccgttcctgacgctgagacgcgaaagctaggggagcgaacagg

SEQ ID NO: 2451 - DNA, 253 bp, Dyadobacter sp.; identical to SEQ ID NO: 2268
  Phylum: Bacteroidetes; Class: Cytophagia; Order: Cytophagales; Family: Cytophagaceae

SEQ ID NO: 2452 - DNA, 253 bp, Unknown
  Description of Unknown: Bacterium polynucleotide
  Phylum: Proteobacteria; Class: Betaproteobacteria; Order: IS-44
tacgtagggtgcgagcgttaatcggaattactgggcgtaaagcgtgcgcaggcggttcgccaagtcaggtgtgaaatccccgggcttaacctgggaattgcgcttgaaactagcgggcttgagtgtggcagaggggggtggaattccacgtgtagcagtgaaatgcgtagagatgtggaggaacaccgatggcgaaggcagccccctgggtcaacactgacgctcatgcacgaaagcgtggggagcaaacagg

SEQ ID NO: 2453 - DNA, 253 bp, Chryseobacterium sp.
  Phylum: Bacteroidetes; Class: Flavobacteriia; Order: Flavobacteriales; Family: Weeksellaceae
tacggagggtgcaagcgttatccggatttattgggtttaaagggtccgtaggcggacctgtaagtcagtggtgaaatctcatagcttaactatgaaactgccattgatactgcaggtcttgagtaaatttgaagtggctggaataagtagtgtagcggtgaaatgcatagatattacttagaacaccaattgcgaaggcaggtcactaagatttaactgacgctgagggacgaaagcgtggggagcgaacagg

SEQ ID NO: 2454 - DNA, 253 bp, Unknown
  Description of Unknown: Bacterium polynucleotide
  Phylum: Proteobacteria; Class: Deltaproteobacteria; Order: Myxococcales
tacagagggtgcaagcgttgttcggaattattgggcgtaaagcgcgtgtaggcggcttggcaagtcagatgtgaaagccctcggcttaaccgaggaagtgcgtctgaaactgctgagcttgagtctcggagaggatggcggaattccgcaagtagaggtgaaattcgtagatatgcggaggaacaccggtggcgaaggcggccatctggacgagtactgacgctgagacgcgaaagcgtggggagcaaacagg

SEQ ID NO: 2455 - DNA, 253 bp, Unknown
  Description of Unknown: Bacterium polynucleotide
  Phylum: Proteobacteria; Class: Deltaproteobacteria; Order: Myxococcales
gacagagggtgcaaacgttgttcggaattactgggcgtaaagcgcgtgtaggcggcaatacaagtcggatgtgaaatcccgcggcttaaccgtggaagtgcacccgaaactgtatcgctagagtcccggagaggatggtggaatacttggtgtagaggtgaaattcgtagatatcaagtggaacaccggtggcgaaggcggccatctggacggtgactgacgctgagacgcgaaagcgtgggtagcaaacagg

SEQ ID NO: 2456 - DNA, 253 bp, Devosia sp.
  Phylum: Proteobacteria; Class: Alphaproteobacteria; Order: Rhizobiales; Family: Hyphomicrobiaceae
tacgaagggggctagcgttgttcggatttactgggcgtaaagcgcacgtaggcggattgttaagtcaggggtgaaatcctggagctcaactccagaactgcctttgatactggcagtctagagaccggaagaggtgagtggaacccctagtgtagaggtggaattcgtagatattaggaaggacaccagtggcgaaggcggctcactggtccggtactgacgctgaggtgcgaaagcgtggggagcaaacagg

SEQ ID NO: 2457 - DNA, 253 bp, Unknown
  Description of Unknown: Bacterium polynucleotide
  Phylum: Bacteroidetes; Class: Saprospirae; Order: Saprospirales; Family: Chitinophagaceae
tacggagggtgcaagcgttatccggattcactgggtttaaagggtgcgtaggtgggtatgtaagtcagtggtgaaatccccgagcttaacttgggaactgccgttgatactatatatcttgaatgtcgtagaggtaagcggaatatgtcatgtagcggtgaaatgcttagagatgacatagaacaccaattgcgaaggcagcttgctatgcgattattgacactgaggcacgaaagcgtgggtagcaaacagg

SEQ ID NO: 2458 - DNA, 253 bp, Luteolibacter sp.
  Phylum: Verrucomicrobia; Class: Verrucomicrobiae; Order: Verrucomicrobiales; Family: Verrucomicrobiaceae
tacgaaggtcccgagcgttgttcggaatcactgggcgtaaagggagcgtaggcggcatggtaagtcagatgtgaaatcccggggctcaaccccggaactgcatccgatactgccttgcttgagggttggagaggtgactggaattctcggtgtagcagtgaaatgcgtggatatcgagaggaacactcgtggcgaaggcgagtcactggacaacatctgacgctgaggctcgaaggctaggggagcaaaaggg

SEQ ID NO: 2459 - DNA, 253 bp, Rhodoferax sp.
  Phylum: Proteobacteria; Class: Betaproteobacteria; Order: Burkholderiales; Family: Comamonadaceae
tacgtagggtgcgagcgttaatcggaattactgggcgtaaagcgtgcgcaggcggttatgtaagacagatgtgaaatccccgggctcaacctgggacctgcatttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 2460 - DNA, 253 bp, Cellvibrio sp.
  Phylum: Proteobacteria; Class: Gammaproteobacteria; Order: Alteromonadales; Family: Alteromonadaceae
tacggagggtgcaagcgttaatcggaattactgggcgtaaagcgcacgtaggtggtttgctaagtcagctgtgaaatccccgggctcaacctgggcactgcagttgaaactggcaagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 2461 - DNA, 253 bp, Rhodanobacter sp.; identical to SEQ ID NO: 2407
  Phylum: Proteobacteria; Class: Gammaproteobacteria; Order: Xanthomonadales; Family: Xanthomonadaceae

SEQ ID NO: 2462 - DNA, 253 bp, Unknown
  Description of Unknown: Bacterium polynucleotide
  Phylum: Proteobacteria; Class: Alphaproteobacteria; Order: Rhizobiales
tacgaagggggctagcgttgttcggaattactgggcgtaaagcgcacgtaggcggacatttaagtcaggggtgaaatcccggagctcaactccggaactgcctttgatactgggtgtctcgagtatggaagaggtgagtggaattccgagtgtagaggtgaaattcgtagatattcggaggaacaccagtggcgaaagcaactcactgatccattactgacgctgaggtacgaaagcgtggggagcaaacagg

SEQ ID NO: 2463 - DNA, 253 bp, Deinococcus geothermalis
  Phylum: Thermi; Class: Deinococci; Order: Deinococcales; Family: Deinococcaceae
tacggagggtgcaagcgttacccggaatcactgggcgtaaagggcgtgtaggcggaaggttaagtccgactttaaagaccggggctcaaccccgggcctgggttggagactggctttctggacctctggagaggcaactggaattcctggtgtagcggtggaatgcgtagataccaggaggaacaccgatggcgaaggcaggttgctggacagaaggtgacgctgaggcgcgaaagtgtggggagcgaaccgg

SEQ ID NO: 2464 - DNA, 253 bp, Janthinobacterium sp.
  Phylum: Proteobacteria; Class: Betaproteobacteria; Order: Burkholderiales; Family: Oxalobacteraceae
tacgtagggtgcaagcgttaatcggaattactgggcgtaaagcgtgcgcaggcggttttgtaagtctgtcgtgaaagccccgggcttaacctgggaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 2465 - DNA, 253 bp, Bacillus racemilacticus
  Phylum: Firmicutes; Class: Bacilli; Order: Bacillales; Family: Sporolactobacillaceae
tacgtaggtggcaagcgttgtccggaattattgggcgtaaagcgcgcgcaggcggtttcttaagtctgatgtgaaagcccccagctcaactggggagggtcattggaaactgggaaacttgagtacagaagaggagagtagaattccacgtgtagcggtgaaatgcgtagagatgtggaggaataccagtggcgaaggcggctctctggtctgtaactgacgctgaggcgcgaaagcgtggggagcaaacagg

SEQ ID NO: 2466 - DNA, 253 bp, Agrobacterium sp.
  Phylum: Proteobacteria; Class: Alphaproteobacteria; Order: Rhizobiales; Family: Rhizobiaceae
tacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacagg

SEQ ID NO: 2467 - DNA, 253 bp, Cellvibrio sp.
  Phylum: Proteobacteria; Class: Gammaproteobacteria; Order: Alteromonadales; Family: Alteromonadaceae
tacggagggtgcaagcgttaatcggaattactgggcgtaaagcgcacgtaggtggttcgctaagtcagctgtgaaatccccgggctcaacctgggacttgcagttgaaactggtgagctagagtagggtagaggggtgtggaattccaggtgtagcggtgaaatgcgtagatatctaaaggaacatcagtggcgaaaacaacaccctggactcatactgacactgaggtgcgaaagcgtggggagcaaacagg

SEQ ID NO: 2468 - DNA, 253 bp, Cytophaga sp.
  Phylum: Bacteroidetes; Class: Cytophagia; Order: Cytophagales; Family: Cytophagaceae
tacgtaggtggcaagcgttgtccggatttattgggtttaaagggtgcgtaggcggcattataagtcagtggtgaaagccgatcgcttaacgatcgaactgccattgatactgtagtgcttgagtatagttgaggtaggcggaattgacagtgtagcggtgaaatgcatagatattgtcaagaacaccaattgcgaaggcagcttactaaagtataactgacgctgaggcacgaaagtgcggggatcaaacagg

SEQ ID NO: 2469 - DNA, 253 bp, Unknown
  Description of Unknown: Bacterium polynucleotide
  Phylum: Proteobacteria; Class: Alphaproteobacteria; Order: BD7-3
tacggagggagcgagcgttgttcggaattactgggcgtaaagggtgcgcaggcggctatgtaagtcggaagtgaaatcccagggcttaaccctggaattgctttcgaaactatatagctcgagtctcggagaggttagcggaattcctagtgtagaggtgaaattcgtagatattaggaggaacaccagtggcgtaagcggctaactagacgagtactgacgctcaagcacgaaagcgtggggatcaaacagg

SEQ ID NO: 2470 - DNA, 253 bp, Ammoniphilus sp.
  Phylum: Firmicutes; Class: Bacilli; Order: Bacillales; Family: Paenibacillaceae
tacgtagggggcaagcgttgtccggaattattgggcgtaaagcgcgcgcaggcggcctattaagtctgatgtgaaagcccacggctcaaccgtggagggccattggaaactggtaggcttgagtgcaggagaggagagcggaattcctggtgtagcggtgaaatgcgtagatatcaggaggaacacccgtggcgaaggcggctctctggcctgtaactgacgctgaggcgcgaaagcgtggggagcaaacagg

SEQ ID NO: 2471 - DNA, 253 bp, Unknown
  Description of Unknown: Bacterium polynucleotide
  Phylum: Proteobacteria; Class: Betaproteobacteria; Order: Burkholderiales; Family: Comamonadaceae
tacgtagggtgcaagcgttaatcggaattactgggcgtaaagcgtgcgcaggcggtgatgtaagacaggtgtgaaatccccgggcttaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 2472 - DNA, 253 bp, Devosia sp.
  Phylum: Proteobacteria; Class: Alphaproteobacteria; Order: Rhizobiales; Family: Hyphomicrobiaceae
tacgaagggggctagcgttgttcggatttactgggcgtaaagcgcacgtaggcggtttgttaagtcaggggtgaaatcccggagctcaactccggaactgcctttgatactggcaagctagagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 2473 - DNA, 253 bp, Janthinobacterium sp.
  Phylum: Proteobacteria; Class: Betaproteobacteria; Order: Burkholderiales; Family: Oxalobacteraceae
tacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaagattgacgctcatgcacgaaagcgtggggagcaaacagg

SEQ ID NO: 2474 - DNA, 253 bp, Pedobacter sp.
  Phylum: Bacteroidetes; Class: Sphingobacteriia; Order: Sphingobacteriales; Family: Sphingobacteriaceae
tacggaggatccaagcgttatccggatttattgggtttaaagggcgcgtaggcggcctgttaagtcaggggtgaaagacggtagctcaactatcgcagtgcccttgatactgacgggcttgaattgactagaggtaggcggaatgagacaagtagcggtgaaatgcatagatatgtctcagaacaccgattgcgaaggcagcttactatggtcacattgacgctgaggcacgaaagcgtggggatcaaacagg

SEQ ID NO: 2475 - DNA, 253 bp, Flavisolibacter sp.
  Phylum: Bacteroidetes; Class: Saprospirae; Order: Saprospirales; Family: Chitinophagaceae
tacggagggtgcaagcgttatccggattcactgggtttaaagggtgcgtaggagggcaggtaagtcagtggtgaaatctccgagcttaactcggaaactgccgttgatactatctgtcttgaatattgtggaggtgagcggaatatgtcatgtagcggtgaaatgcttagatatgacatagaacaccaattgcgaaggcagctcgctacacatatattgactctgaggcacgaaagcgtggggatcaaacagg

SEQ ID NO: 2476 - DNA, 253 bp, Asticcacaulis sp.
  Phylum: Proteobacteria; Class: Alphaproteobacteria; Order: Caulobacterales; Family: Caulobacteraceae
tacgaagggggctagcgttgctcggaattactgggcgtaaagggagcgtaggcgggttatcaagttgggggtgaaagcccggggctcaacctcggaattgccttcaaaactggtagcctagagtatgatagaggtatgtggaactccgagtgtagaggtgaaattcgtagatattcggaagaacaccagtggcgaaggcgacatactgggtcatgactgacgctgaggctcgaaagcgtggggagcaaacagg

SEQ ID NO: 2477 - DNA, 253 bp, Unknown
  Description of Unknown: Bacterium polynucleotide
  Phylum: Proteobacteria; Class: Gammaproteobacteria; Order: Xanthomonadales; Family: Xanthomonadaceae
tacgaagggtgcaagcgttactcggaattactgggcgtaaagcgtgcgtaggtggtgatttaagtcagatgtgaaagccctgggctcaacctgggaactgcatttgatactgggtcactagagtgcggtagaggatagcggaattcctggtgtagcagtgaaatgcgtagagatcaggaggaacatccgtggcgaaggcggctatctgggccagcactgacactgaggcacgaaagcgtggggagcaaacagg

SEQ ID NO: 2478 - DNA, 253 bp, Flavisolibacter sp.
  Phylum: Bacteroidetes; Class: Saprospirae; Order: Saprospirales; Family: Chitinophagaceae
tacggagggtgcaagcgttatccggattcactgggtttaaagggtgcgtaggagggcaggtaagtcagtggtgaaatctccaagcttaacttggaaactgccgttgatactatctgtcttgaataccgtggagatgagcggaatatgtcatgtagcggtgaaatgcttagatatgacatagaacaccaattgcgaaggcagctcgttacacgaatattgactctgaggcacgaaagcgtggggatcaaacagg

SEQ ID NO: 2479 - DNA, 253 bp, Pseudomonas sp.; identical to SEQ ID NO: 2395
  Phylum: Proteobacteria; Class: Gammaproteobacteria; Order: Pseudomonadales; Family: Pseudomonadaceae

SEQ ID NO: 2480 - DNA, 253 bp, Unknown
  Description of Unknown: Bacterium polynucleotide
  Phylum: Planctomycetes; Class: Planctomycetia; Order: Pirellulales; Family: Pirellulaceae
gacgagctctccaaacgttattcggtatcactgggcttaaagagttcgtaggcggcttgacaggtgaggtgtgaaagcccacggcctaaccgtggaattgcgcttcaaaccgtcgggctagagggatgcaggggtatgcggaacagatggtggagcggtgaaatgcgttgatatcatctggaacaccggtggcgaaagcggcatactgggcattttctgacgctgaggaacgaaagctagggtagcgaacggg

SEQ ID NO: 2481 - DNA, 253 bp, Unknown
  Description of Unknown: Bacterium polynucleotide
  Phylum: Bacteroidetes; Class: Saprospirae; Order: Saprospirales; Family: Chitinophagaceae
tacggagggtgcaagcgttatccggatttactgggtttaaagggtgcgtaggtgggtctgtaagtcagtggtgaaatctccgagcttaactcggaaactgccattgatactataggtcttgaattatctggaggtaagcggaatatgtcatgtagcggtgaaatgcttagatatgacatagaacaccaattgcgaaggcagcttactacggattgattgacactgaggcacgaaagcgtggggatcaaacagg

SEQ ID NO: 2482 - DNA, 253 bp, Unknown
  Description of Unknown: Bacterium polynucleotide
  Phylum: Proteobacteria; Class: Gammaproteobacteria; Order: Pseudomonadales; Family: Pseudomonadaceae
tacgaagggtgcaagcgttactcggaattactgggcgtaaagcgcgcgtaggtggttcgttaagttggatgtgaaatccccgggctcaacctgggaactgcactcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 2483 - DNA, 253 bp, Unknown
  Description of Unknown: Bacterium polynucleotide
  Phylum: Proteobacteria; Class: Alphaproteobacteria; Order: Rhizobiales; Family: Rhizobiaceae
tacgaagggggctagcgttgttcggaattactgggcgtaaagcgcacgtaggcgggtatttaagtcgggggtgaaatcccggagctcaactccggaactgcctttgatactgggtacctagagtatggaagaggtaagtggaattccgagtgtagaggtgaaattcgtggatattcggaggaacaccagtggcgaaggcggctcactggtccattactgacgctgaggtgcgaaagcgtggggagcaaacagg

SEQ ID NO: 2484 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggctttgtaagtcttgtgtttaagttcggggcttaaccccgtgtcgcatgggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 2485 - DNA, 253 bp, Chitinophaga sp.
  Phylum: Bacteroidetes; Class: Saprospirae; Order: Saprospirales; Family: Chitinophagaceae
tacggagggtgcaagcgttatccggattcactgggtttaaagggtgcgtaggcggacatgtaagtctgtggtgaaatctccgagcttaactcggaaactgccgtggatactatatgtcttgaatgttgtggaggttagcggaatatgtcatgtagcggtgaaatgcttagatatgacatagaacaccgattgcgaaggcagctggctacacaactattgacgctgaggcacgaaagcgtggggatcaaacagg

SEQ ID NO: 2486 - DNA, 253 bp, Aeromicrobium sp.; identical to SEQ ID NO: 2243
  Phylum: Actinobacteria; Class: Actinobacteria; Order: Actinomycetales; Family: Nocardioidaceae

SEQ ID NO: 2487 - DNA, 253 bp, Novosphingobium sp.
  Phylum: Proteobacteria; Class: Alphaproteobacteria; Order: Sphingomonadales; Family: Sphingomonadaceae
tacggagggagctagcgttgttcggaattactgggcgtaaagcgcacgtaggcggcgactcaagtcaggggtgaaagcccggggctcaaccccggaactgcctttgaaactaggttgctagaatcttggagaggtcagtggaattctgagtgtagaggtgaaattcgtagatattcggaagaacaccagtggcgaaggcggctgactggactggtattgacgctgaggtgcgaaagcgtggggagcaaacagg

SEQ ID NO: 2488 - DNA, 253 bp, Dyadobacter sp.
  Phylum: Bacteroidetes; Class: Cytophagia; Order: Cytophagales; Family: Cytophagaceae
tacggagggtgcgagcgttgtccggatttattgggtttaaagggtgcgtaggtggctaattaagtcagtggtgaaatacagccgcttaacggttgaggtgccattgatactgactagcttgaaagaattggaggctgccggaatggatggtgtagcggtgaaatgcatagatatcatccagaacaccgattgcgaaggcaggtggctacgatttatttgacactgaggcacgaaagcatggggagcaaacagg

SEQ ID NO: 2489 - DNA, 253 bp, Paenisporosarcina sp.
  Phylum: Firmicutes; Class: Bacilli; Order: Bacillales; Family: Planococcaceae
tacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccaagtgtagcggtgaaatgcgtagagatttggaggaacaccagtggcgaaggcggctttctggtctgtaactgacgctgaggcgcgaaagcgtggggagcaaacagg

SEQ ID NO: 2490 - DNA, 252 bp, Cohnella sp.
  Phylum: Firmicutes; Class: Bacilli; Order: Bacillales; Family: Paenibacillaceae
tacgtagggggcaagcgttgtccggaattattgggcgtaaagcgcgcgcaggcggtttcttaagtctggtgtctaagtgcggggctcaaccccgtgatgcactggaaactgggagactcgagtgcagaagaggagagcggaattccacgtgtagcggtgaaatgcgtagagatgtggaggaacaccagtggcgaaggcggctttttggcctgtaactgacgctgaggcgcgaaagcgtggggagcaaacagg

SEQ ID NO: 2491 - DNA, 253 bp, Unknown
  Description of Unknown: Bacterium polynucleotide
  Phylum: Firmicutes; Class: Bacilli; Order: Bacillales
tacgtaggtggcaagcgttgtccggaattattgggcgtaaagcgcgcgcaggtggtctcttaagtctgatgtgaaagcccccggctcaaccggggagggtcattggaaactgggagacttgagtgcaggagagaagagtggaattccacgtgtagcggtgaaatgcgtagagatgtggaggaacaccagtggcgaaggcgactctttggcctgtaactgacactgaggcgcgaaagcgtggggagcaaacagg

SEQ ID NO: 2492 - DNA, 253 bp, Hymenobacter sp.
  Phylum: Bacteroidetes; Class: Cytophagia; Order: Cytophagales; Family: Cytophagaceae
tacggagggtgcgagcgttgtccggatttattgggtttaaagggtgcgtaggcggcccgttaagtccggggtgaaagcccgctgctcaacagcggaactgccctggatactgacgggcttgagtacagacgaggttggcggaatggactgagtagcggtgaaatgcatagatacagtccagaaccccgattgcgaaggcagctgactaggctgttactgacgctgaggcacgaaagcgtggggagcgaacagg

SEQ ID NO: 2493 - DNA, 253 bp, Chondromyces sp.
  Phylum: Proteobacteria; Class: Deltaproteobacteria; Order: Myxococcales; Family: Polyangiaceae
gacagagggtgcaaacgttgttcggaatgactgggcgtaaagcgcgtgtaggcggctcggcaagtcgggtgtgaaagccctgggctcaacccaggaagtgcactcgaaactgccgagctggagtcccggagaggaaggcggaattctcggtgtagaggtgaaattcgtagatatcgagaggaacaccggtggcgaaggcggccttctggacggcgactgacgctgagacgcgaaagcgtggggagcaaacagg

SEQ ID NO: 2494 - DNA, 253 bp, Methylotenera mobilis
  Phylum: Proteobacteria; Class: Betaproteobacteria; Order: Methylophilales; Family: Methylophilaceae
tacgtagggtgcgagcgttaatcggaattactgggcgtaaagcgtgcgcaggcggtttggcaagtcagatgtgaaatccccgagctcaacttgggaactgcgtttgaaactgccagactagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 2495 - DNA, 253 bp, Devosia sp.
  Phylum: Proteobacteria; Class: Alphaproteobacteria; Order: Rhizobiales; Family: Hyphomicrobiaceae
tacgaagggggctagcgttgttcggatttactgggcgtaaagcgcacgtaggcggatcgttaagtcgggggtgaaatcctggagctcaactccagaactgccttcgatactggcgatcttgagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 2496 - DNA, 253 bp, Unknown
  Description of Unknown: Bacterium polynucleotide
  Phylum: Bacteroidetes; Class: Saprospirae; Order: Saprospirales; Family: Chitinophagaceae
tacggagggtgcaagcgttatccggattcactgggtttaaagggtgcgtaggcgggtatgtaagtcagtggtgaaatcctcgagcttaactcgagaactgccattgatactatgtatcttgaatgtcatggaggtgagcggaatatgtcatgtagcggtgaaatgcttagatatgacatagaacaccgattgcgaaggcagctcactacacgaatattgacgctgaggcacgaaagcgtggggatcaaacagg

SEQ ID NO: 2497 - DNA, 253 bp, Flavobacterium sp.
  Phylum: Bacteroidetes; Class: Flavobacteriia; Order: Flavobacteriales; Family: Flavobacteriaceae
tacggaggatccaagcgttatccggaatcattgggtttaaagggtccgtaggcggtttaataagtcagtggtgaaagcctatcgcttaacgatagaacggccattgatactgttagacttgaattagtgggaagtaactagaatatgtagtgtagcggtgaaatgcttagatattacatggaataccaattgcgaaggcaggttactatcactatattgacgctgatggacgaaagcgtggggagcgaacagg

SEQ ID NO: 2498 - DNA, 253 bp, Simplicispira sp.
  Phylum: Proteobacteria; Class: Betaproteobacteria; Order: Burkholderiales; Family: Comamonadaceae
tacgtagggtgcaagcgttaatcggaattactgggcgtaaagcgtgcgcaggcggttatataagacagatgtgaaatccccgggctcaacctgggaactgcattagtgactgtatagctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 2499 - DNA, 253 bp, Novosphingobium sp.
  Phylum: Proteobacteria; Class: Alphaproteobacteria; Order: Sphingomonadales; Family: Sphingomonadaceae
tacggagggagctagcgttgttcggaattactgggcgtaaagcgcacgtaggcggctactcaagtcagaggtgaaagcccggggctcaaccccggaactgcctttgaaactaggtagctggaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 2500 - DNA, 252 bp, Paenibacillus barengoltzii
  Phylum: Firmicutes; Class: Bacilli; Order: Bacillales; Family: Paenibacillaceae
tacgtagggggcgagcgttgtccggaattattgggcgtaaagcgcgcgcaggcggctgtttaagtctggtgtttaatcctggggctcaaccccgggtcgcactggaaactggacagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 2501 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggttttttaagtctggggtttaagttcggggctcaaccccgtatcgccctggaaactggggaactggagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 2502 - DNA, 253 bp, Microbacterium sp.
  Phylum: Actinobacteria; Class: Actinobacteria; Order: Actinomycetales; Family: Microbacteriaceae
tacgtagggcgcaagcgttatccggaattattgggcgtaaagagctcgtaggcgatttgtcgcgtctgctgtgaaattccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacagg

SEQ ID NO: 2503 - DNA, 252 bp, Streptococcus sp.
  Phylum: Firmicutes; Class: Bacilli; Order: Lactobacillales; Family: Streptococcaceae
tacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggcctgtaactgacactgaggctcgaaagcgtggggagcaaacagg

SEQ ID NO: 2504 - DNA, 253 bp, Haemophilus parainfluenzae
  Phylum: Proteobacteria; Class: Gammaproteobacteria; Order: Pasteurellales; Family: Pasteurellaceae
tacggagggtgcgagcgttaatcggaataactgggcgtaaagggcacgcaggcggtgacttaagtgaggtgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 2505 - DNA, 253 bp, Thermoanaerobacterium sp.
  Phylum: Firmicutes; Class: Clostridia; Order: Clostridiales; Family: Clostridiaceae
tacgtagggggcaagcgttgtccggagtgactgggcgtaaagggcgcgtaggcggttatacaagtcaggtgtaaaagataccggctcaaccggtaggtagcatctgatactgtataactagagtacaggagaggggagcggaattcctggtgtagcggtgaaatgcgtagagatcaggaagaacaccggtggcgaaggcggctctctggcctgggactgacgctgaggcgcgaaagcgtggggagcgaacagg

SEQ ID NO: 2506 - DNA, 253 bp, Methyloversatilis sp.
  Phylum: Proteobacteria; Class: Betaproteobacteria; Order: Rhodocyclales; Family: Rhodocyclaceae
tacgtagggtgcgagcgttaatcggaattactgggcgtaaagcgtgcgcaggcggttgtgtaagacaggtgtgaaatccccgggcttaacctgggaactgcgcttgtgactgcacagctagagtatggcagaggggggtggaattccacgtgtagcagtgaaatgcgtagagatgtggaggaacaccgatggcgaaggcagccccctgggccaatactgacgctcatgcacgaaagcgtggggagcaaacagg

SEQ ID NO: 2507 - DNA, 253 bp, Caloramator sp.
  Phylum: Firmicutes; Class: Clostridia; Order: Clostridiales; Family: Clostridiaceae
tacgtaggtggcaagcgttgtccggaattactgggcgtaaagggtgcgtaggcggtcctttaagtgggatgtgaaatccctgggcttaacccaggaactgcattccaaactggaggactagagtgcaggagaggaaagcggtattcccagtgtagcggtgaaatgcgtagagattgggaggaacaccagtagcgaaggcggctttctggaatgtaactgacgctgaggcacgaaagcgtggggagcaaacagg

SEQ ID NO: 2508 - DNA, 253 bp, Steroidobacter sp.
  Phylum: Proteobacteria; Class: Gammaproteobacteria; Order: Xanthomonadales; Family: Sinobacteraceae
tacagagggtgcgagcgttaatcggaattactgggcgtaaagcgcgcgtaggcggctttgtaagtcggttgtgaaatccccgggcttaacctgggaactgcatccgagactgcatagctagagtatgggagagggaagtggaatttcaggtgtagcggtgaaatgcgtagatatctgaaggaacatcagtggcgaaagcgacttcctggaccaatactgacgctcatgtgcgaaagcgtggggagcaaacagg

SEQ ID NO: 2509 - DNA, 253 bp, Actinomyces sp.
  Phylum: Actinobacteria; Class: Actinobacteria; Order: Actinomycetales; Family: Actinomycetaceae
tacgtagggcgcgagcgttgtccggaattattgggcgtaaagggcttgtaggcggctggtcgcgtctgccgtgaaattctccggctcaaccgggggcttgcggtgggtacgggccggctggagtgcggtaggggaggctggaactcctggtgtagcggtggaatgcgcagatatcaggaggaacaccggtggcgaaggcgggtctctgggccgttactgacgctgaggagcgaaagcgtggggagcgaacagg

SEQ ID NO: 2510 - DNA, 252 bp, Cohnella sp.
  Phylum: Firmicutes; Class: Bacilli; Order: Bacillales; Family: Paenibacillaceae
tacgtagggggcaagcgttgtccggaattattgggcgtaaagcgcgcgcaggcggttctttaagtctggtgtctaagtgcggggctcaaccccgtgatgcactggaaactggggaacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacagg

SEQ ID NO: 2511 - DNA, 253 bp, Unknown
  Description of Unknown: Bacterium polynucleotide
  Phylum: Bacteroidetes; Class: Sphingobacteriia; Order: Sphingobacteriales
gacgaaggatgcaagcgttatccggattcattgggtttaaagggtgcgtaggcggacctgtaagtcagtggtgaaatctctcagcttaactgagaaactgccattgatactgcaggtctagagtatagatgacgttggcggaatatgacatgtagtggtgaaatacttagatatgtcatagaacaccgattgcgaaggcagctaacgaaactataactgacgctgaggcacgaaagtgcggggatcaaacagg

SEQ ID NO: 2512 - DNA, 253 bp, Unknown
  Description of Unknown: Bacterium polynucleotide
  Phylum: Bacteroidetes; Class: Saprospirae; Order: Saprospirales; Family: Chitinophagaceae
tacggagggtgcaagcgttatccggattcactgggtttaaagggtgcgtaggcgggcatttaagtcagtggtgaaatacctgagcttaacttgggaactgccattgatactatttgtcttgaatgtcgtggaggttagcggaatatgtcatgtagcggtgaaatgcttagatatgacatagaacacctattgcgaaggcagctaactacgcgaatattgacgctgaggcacgaaagcgtggggatcaaacagg

SEQ ID NO: 2513 - DNA, 253 bp, Sphingomonas sp.
  Phylum: Proteobacteria; Class: Alphaproteobacteria; Order: Sphingomonadales; Family: Sphingomonadaceae
tacggagggagctagcgttgttcggaattactgggcgtaaagcacacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgatgctgaggtgcgaaagcgtggggagcgaacagg

SEQ ID NO: 2514 - DNA, 253 bp, Unknown
  Description of Unknown: Bacterium polynucleotide
  Phylum: Firmicutes; Class: Bacilli; Order: Bacillales
tacgtaggtggcaagcgttatccggaattattgggcgtaaagcgcgcgcaggcggtctcttaagtctgatgtgaaagcccacggctcaaccgtggagggtcattggaaactgggagacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacagg

SEQ ID NO: 2515 - DNA, 253 bp, Stenotrophomonas sp.
  Phylum: Proteobacteria; Class: Gammaproteobacteria; Order: Xanthomonadales; Family: Xanthomonadaceae
tacgaagggtgcaagcgttactcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctacctggaccaacactgacactgaggcacgaaagcgtggggagcaaacagg

SEQ ID NO: 2516 - DNA, 253 bp, Mycoplana sp.
  Phylum: Proteobacteria; Class: Alphaproteobacteria; Order: Caulobacterales; Family: Caulobacteraceae
tacgaagggggctagcgttgctcggaattactgggcgtaaagggagcgtaggcggacatttaagtcaggggtgaaatcccagagctcaactctggaactgcctttgatactggatgtcttgagtgtgagagaggtaagtggaactccgagtgtagaggtgaaattcgtagatattcggaagaacaccagtggcgaaggcgacttactggctcattactgacgctgaggctcgaaagcgtggggagcaaacagg

SEQ ID NO: 2517 - DNA, 252 bp, Unknown
  Description of Unknown: Bacterium polynucleotide
  Phylum: Firmicutes; Class: Bacilli; Order: Bacillales; Family: Paenibacillaceae
tacgtagggggcaagcgttgtccggaattattgggcgtaaagcgcgcgcaggcggtcctttaagtcttgtgtttaatcccagagctcaactttggtacgcatgggaaactggaggactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacagg

SEQ ID NO: 2518 - DNA, 253 bp, Unknown
  Description of Unknown: Bacterium polynucleotide
  Phylum: Proteobacteria; Class: Alphaproteobacteria; Order: Sphingomonadales; Family: Erythrobacteraceae
tacggagggagctagcgttgttcggaattactgggcgtaaagcgcacgtaggcggcgatccaagtcagaggtgaaatcccggggctcaaccccggaactgcctttgaaactagattgctagaatcctggagaggtgagtggaattccgagtgtagaggtgaaattcgtagatattcggaagaacaccagtggcgaaggcgactcactggacaggtattgacgctgaggtgcgaaagcgtggggagcaaacagg

SEQ ID NO: 2519 - DNA, 253 bp, Unknown
  Description of Unknown: Bacterium polynucleotide
  Phylum: Firmicutes; Class: Bacilli; Order: Bacillales
tacgtaggtggcaagcgttgtccggaattattgggcgtaaagagcgcgcaggcggtcttttaagtctgatgtgaaagcccctggctcaaccggggagggtcattggaaactgggagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacagg

SEQ ID NO: 2520 - DNA, 253 bp, Pseudomonas sp.
  Phylum: Proteobacteria; Class: Gammaproteobacteria; Order: Pseudomonadales; Family: Pseudomonadaceae
tacagagggtgcaggcgttaatcggaattactgggcgtaaagcgcgcgtaggtggttcgttaagttggatgtgaaatccccgggctcaacccgggaactgcattcaaaactgacgagctagagtatggtagagggtggtggaatttcctgtgtagcggtgaaatgtgtagatataggaaggaacaccagtggcgaaggcgaccacctggactgatactgacgctgaggtgcgaaagcgtggggagcaaacagg

SEQ ID NO: 2521 - DNA, 253 bp, Mycoplana sp.
  Phylum: Proteobacteria; Class: Alphaproteobacteria; Order: Caulobacterales; Family: Caulobacteraceae
tacgaagggggctagcgttgctcggaattactgggcgtaaagggcgcgtaggcggacatttaagtcaggggtgaaatcccgaggctcaacctcggaattgcctttgatactgggtgtcttgagtgtgagagaggtatgtggaactccgagtgtagaggtgaaattcgtagatattcggaagaacaccagtggcgaaggcgacatactggctcattactgacgctgaggcgcgaaagcgtggggagcaaacagg

SEQ ID NO: 2522 - DNA, 253 bp, Devosia sp.
  Phylum: Proteobacteria; Class: Alphaproteobacteria; Order: Rhizobiales; Family: Hyphomicrobiaceae
tacgaagggggctagcgttgttcggatttactgggcgtaaagcgcacgtaggcggtttgttaagtcagaggtgaaatcccggagctcaactccggaactgcctttgatactggcaagctagagtccggaagaggtaagtggaactcctagcgtagaggtggaattcgtagatattaggaagaacaccagtggcgaaggcggcttactggtccggaactgacgctcatgcacgaaagcgtggggagcaaacagg

SEQ ID NO: 2523 - DNA, 253 bp, Bradyrhizobium sp.
  Phylum: Proteobacteria; Class: Alphaproteobacteria; Order: Rhizobiales; Family: Bradyrhizobiaceae
tacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 2524 - DNA, 253 bp, Dyadobacter sp.
  Phylum: Bacteroidetes; Class: Cytophagia; Order: Cytophagales; Family: Cytophagaceae
tacggagggtgcgagcgttgtccggatttattgggtttaaagggtgcgtaggtggcctagtaagtcagtggtgaaatacggttgctcaacaatcgaggtgccattgatactgcaaggcttgaaataattggaggctgccggaatggatggtgtagcggtgaaatgcatagatatcatccagaacaccgattgcgaaggcaggtggctacgatttgtttgacactgaggcacgaaagcatggggagcaaacagg

SEQ ID NO: 2525 - DNA, 253 bp, Unknown
  Description of Unknown: Bacterium polynucleotide
  Phylum: Bacteroidetes; Class: Saprospirae; Order: Saprospirales; Family: Chitinophagaceae
tacggagggtgcaagcgttatccggatttactgggtttaaagggtgcgtaggtgggctgataagtcagtggtgaaatcttcgagcttaactcggaaactgccgttgatactattagtcttgaattttctggaggtaagcggaatatgtcatgtagcggtgaaatgcttagatatgacatagaacaccaattgcgaaggcagcttgctacaggaacattgacactgaggcacgaaagcgtggggatcaaacagg

SEQ ID NO: 2526 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggccgcttaagtttggtgtataagcccggggctcaaccccggatcgcaccgaaaactgggtggcttgagtgcaggagaggaaagcggaattccacgtgtagcggtgaaatgcgtagagatgtggaggaacaccagtggcgaaggcggctttctggactgtaactgacgctgaggcgcgaaagcgtggggagcaaacagg

SEQ ID NO: 2527 - DNA, 253 bp, Achromobacter sp.
  Phylum: Proteobacteria; Class: Betaproteobacteria; Order: Burkholderiales; Family: Alcaligenaceae
tacgtagggtgcaagcgttaatcggaattactgggcgtaaagcgtgcgcaggcggttcggaaagaaagatgtgaaatcccagagcttaactttggaactgcattttcaactcccgagctagagtgtgtcagagggaggtggaattccgcgtgtagcagtgaaatgcgtagatatgcggaggagcaccgatggcgaaggcagcctcctgggataacactgacgctcatgcacgaaagcgtggggagcaaacagg

SEQ ID NO: 2528 - DNA, 253 bp, Bacillus firmus; identical to SEQ ID NO: 2301
  Phylum: Firmicutes; Class: Bacilli; Order: Bacillales; Family: Bacillaceae

SEQ ID NO: 2529 - DNA, 253 bp, Agrobacterium sp.
  Phylum: Proteobacteria; Class: Alphaproteobacteria; Order: Rhizobiales; Family: Rhizobiaceae
tacgaagggggctagcgttgttcggaattactgggcgtaaagcgcacgtaggcggacatttaagtcaggggtgaaatcccggggctcaacctcggaactgcctttgatactgggtgtctagagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 2530 - DNA, 253 bp, Caulobacter sp.
  Phylum: Proteobacteria; Class: Alphaproteobacteria; Order: Caulobacterales; Family: Caulobacteraceae
tacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacagg

SEQ ID NO: 2531 - DNA, 253 bp, Flavobacterium sp.
  Phylum: Bacteroidetes; Class: Flavobacteriia; Order: Flavobacteriales; Family: Flavobacteriaceae
tacggaggatccaagcgttatccggaatcattgggtttaaagggtccgtaggcggccctgtaagtcagtggtgaaatctcacggctcaaccgtgaaattgccattgatactgcagggcttgaattatcgggaagcaactagaatatgtagtgtagcggtgaaatgcttagatattacatggaataccgattgcgaaggcaggttgctaccggtggattgacgctgatggacgaaagcgtggggagcgaacagg

SEQ ID NO: 2532 - DNA, 253 bp, Xanthomonas sp.
  Phylum: Proteobacteria; Class: Gammaproteobacteria; Order: Xanthomonadales; Family: Xanthomonadaceae
tacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacagg

SEQ ID NO: 2533 - DNA, 253 bp, Flavobacterium sp.
  Phylum: Bacteroidetes; Class: Flavobacteriia; Order: Flavobacteriales; Family: Flavobacteriaceae
tacggaggatccaagcgttatccggaatcattgggtttaaagggtccgtaggcggctttataagtcagtggtgaaagcccatcgcttaacgatggaacggccattgatactgtagagcttgaattacttggaagtaactagaatatgtagtgtagcggtgaaatgcttagatattacatggaataccaattgcgaaggcaggttactacaagtggattgacgctgatggacgaaagcgtggggagcgaacagg

SEQ ID NO: 2534 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 2535 - DNA, 252 bp, Brevibacillus invocatus
  Phylum: Firmicutes; Class: Bacilli; Order: Bacillales; Family: Paenibacillaceae
tacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgaggagaagagaaagcggggggagcaaacagg

SEQ ID NO: 2536 - DNA, 252 bp, Brevibacillus sp.
  Phylum: Firmicutes; Class: Bacilli; Order: Bacillales; Family: Paenibacillaceae
tacgtaggtggcaagcgttgtccggaattattgggcgtaaagcgcgcgcaggcggctatgtaagtctggtgttaaagcccggggctcaaccccggttcgcatcggaaactgcgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacagg

SEQ ID NO: 2537 - DNA, 253 bp, Unknown
  Description of Unknown: Bacterium polynucleotide
  Phylum: Proteobacteria; Class: Betaproteobacteria; Order: Burkholderiales; Family: Comamonadaceae
tacgtagggtgcaagcgttaatcggaattactgggcgtaaagcgtgcgcaggcggtcttgtaagacagaggtgaaatccccgggctcaacctgggaactgcctttgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 2538 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggcgatgtaagtctggtgtttaaaccttgggctcaacctggggtcgcacgggaaactggatcgcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 2539 - DNA, 253 bp, Arthrobacter psychrolactophilus; identical to SEQ ID NO: 2238
  Phylum: Actinobacteria; Class: Actinobacteria; Order: Actinomycetales; Family: Micrococcaceae

SEQ ID NO: 2540 - DNA, 253 bp, Pseudomonas sp.
  Phylum: Proteobacteria; Class: Gammaproteobacteria; Order: Pseudomonadales; Family: Pseudomonadaceae
tacgaagggtgcaagcgttaatcggaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacagg

SEQ ID NO: 2541 - DNA, 253 bp, Agrobacterium sp.
  Phylum: Proteobacteria; Class: Alphaproteobacteria; Order: Rhizobiales; Family: Rhizobiaceae
tacgaagggggctagcgttgttcggaattactgggcgtaaagcgcacgtaggcggacatttaagtcaggggtgaaatcccagagctcaactctggaactgcctttgatactgggtgtcttgagtgtggaagaggtcagtggaattgcgagtgtagaggtgaaattcgtagatattcgcaggaacaccagtggcgaaggcggctgactggtccacaactgacgctgaggtgcgaaagcgtggggagcaaacagg

SEQ ID NO: 2542 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggctgattaagttcggtgtttaatcctggggctcaaccctaggtcgcactggaaactggttggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 2543 - DNA, 253 bp, Unknown
  Description of Unknown: Bacterium polynucleotide
  Phylum: Proteobacteria; Class: Alphaproteobacteria; Order: Ellin329
tacgaagggggctagcgttgttcggaattactgggcgtaaagcgcgcgcaggcggtcctttaagtcaggggtgaaagcccagagctcaactctggaactgcctttgaaactagaggacttgggtacgggagaggtgagtggaattccgagtgtagaggtgaaattcgtagatattcggaagaacaccagtggcgaaggcggctcactggcccgttaccgacgctcaggcgcgacagcgtggggagcaaacagg

SEQ ID NO: 2544 - DNA, 253 bp, Novosphingobium sp.
  Phylum: Proteobacteria; Class: Alphaproteobacteria; Order: Sphingomonadales; Family: Sphingomonadaceae
tacgtaggatgcaagcgttgttcggaattactgggcgtaaagcgtacgtaggcggttactcaagtcagaggtgaaagcccggggctcaaccccggaactgcctttgaaactaggtagctagaatcttggagaggtcagtggaattccgagtgtagaggtgaaattcgtagatattcggaagaacaccagtggcgaaggcgactgactggacaagtattgacgctgaggtacgaaagcgtggggagcaaacagg

SEQ ID NO: 2545 - DNA, 253 bp, Unknown
  Description of Unknown: Bacterium polynucleotide
  Phylum: Proteobacteria; Class: Betaproteobacteria; Order: Burkholderiales; Family: Comamonadaceae
tacgtagggtgcgagcgttaatcggaattactgggcgtaaagcgtgcgcaggcggctttgcaagacagatgtgaaatccccgggctcaacctgggaactgcatttgtgactgcaaggctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 2546 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 2547 - DNA, 253 bp, Rhodanobacter sp.
  Phylum: Proteobacteria; Class: Gammaproteobacteria; Order: Xanthomonadales; Family: Xanthomonadaceae
tacggagggtgcgagcgttgttcggaattactgggcgtaaagggtgcgtaggcggttgtttaagtctgtcgtgaaatccccgggctcaacctgggaatggcgatggatactgggcagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 2548 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggttcagtaagttggatgtttaaagccggggctcaaccccggtgcgcatccaaaactggtggacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 2549 - DNA, 252 bp, Cohnella sp.
  Phylum: Firmicutes; Class: Bacilli; Order: Bacillales; Family: Paenibacillaceae
tacgtagggggcaagcgttgtccggaattattgggcgtaaagcgcgcgcaggcggtcttttaagtctggtgtttaggtgcggggctcaaccccgtgacgcactggaaactgggagactcgagtgcagaagaggagggcggaattccacgtgtagcggtgaaatgcgtagagatgcggaggaacaccagtggcgaaggcggctctctggactgtaactgacgctgaggcgcgaaagcgtggggagcaaacagg

SEQ ID NO: 2550 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggttttttaagtctggggtttaattgcagggctcaaccctgtatcgcctcggaaactgggagactggagtgtaggagagggaagtggaattccacgtgtagcggtgaaatgcgtagagatgtggaggaacaccagtggcgaaggcgacttcctggcctataactgacgctgaggcgcgaaagcgtggggagcaaacagg

SEQ ID NO: 2551 - DNA, 253 bp, Sphingomonas yabuuchiae; identical to SEQ ID NO: 2333
  Phylum: Proteobacteria; Class: Alphaproteobacteria; Order: Sphingomonadales; Family: Sphingomonadaceae

SEQ ID NO: 2552 - DNA, 253 bp, Acinetobacter johnsonii
  Phylum: Proteobacteria; Class: Gammaproteobacteria; Order: Pseudomonadales; Family: Moraxellaceae
tacagagggtgcgagcgttaatcggatttactgggcgtaaagcgtgcgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacagg

SEQ ID NO: 2553 - DNA, 253 bp, Salinibacterium sp.
  Phylum: Actinobacteria; Class: Actinobacteria; Order: Actinomycetales; Family: Microbacteriaceae
tacgtagggtgcaagcgttatccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 2554 - DNA, 253 bp, Deinococcus sp.
  Phylum: Thermi; Class: Deinococci; Order: Deinococcales; Family: Deinococcaceae
tacggagggtgcaagcgttacccggaatcactgggcgtaaagggcgtgtaggcggttatttaagtctggttttaaagaccggggctcaaccccgggagtggactggatactggatgacttgacctctggagagggaactggaattcctggtgtagcggtggaatgcgtagataccaggaggaacaccaatggcgaaggcaagttcctggacagaaggtgacgctgaggcgcgaaagtgtggggagcgaaccgg

SEQ ID NO: 2555 - DNA, 253 bp, Sphingomonas sp.
  Phylum: Proteobacteria; Class: Alphaproteobacteria; Order: Sphingomonadales; Family: Sphingomonadaceae
tacgaggggagctagcgttattcggaattactgggcgtaaagcgcacgtaggcggctttgtaagtaagaggtgaaagcctggagctcaactccagaactgccttttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 2556 - DNA, 253 bp, Azospirillum sp.
  Phylum: Proteobacteria; Class: Alphaproteobacteria; Order: Rhodospirillales; Family: Rhodospirillaceae
tacgaagggggctagcgttgttcggaattactgggcgtaaagggcgcgtaggcggcctgtttagtcagaagtgaaagccccgggctcaacctgggaatagcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacagg

SEQ ID NO: 2557 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggctaattaagtctggtgtttaaggctggggctcaaccccggttcgcactggaaactggttggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 2558 - DNA, 253 bp, Unknown
  Description of Unknown: Bacterium polynucleotide
  Phylum: Proteobacteria; Class: Alphaproteobacteria; Order: Sphingomonadales; Family: Erythrobacteraceae
tacggagggagctagcgttgttcggatatactgggcgtaaagcgcacgtaggcggcgccgtaagtcaggggtgaaatcccggagctcaactccggaactgcctttgaaactgcggtgctagaatcctggagaggcgagtggaattccgagtgtagaggtgaaattcgtagatattcggaagaacaccagtggcgaaggcgactcgctggacaggtattgacgctgaggtgcgaaagcgtggggagcaaacagg

SEQ ID NO: 2559 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggtttattaagttaggtgtttaatcccggggctcaaccccggttcgcatctgaaactggtgaacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 2560 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggcttggaaagtcgggtgtttaagctcggggctcaaccccgatacgcacccgaaactgccaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 2561 - DNA, 253 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggctttgtaagtcttgtgtttaagttcggggctcaaccccgcaaacgcatgggaaactgcaaggcttgagtgcagcagaggaaagcggaattccacgtgtagcggtgaaatgcgtagagatgtggaggaacaccagtggcgaaggcggctttctgggctgtaactgacgctgaggcgcgaaagcgtggggagcaaacagg

SEQ ID NO: 2562 - DNA, 253 bp, Unknown; identical to SEQ ID NO: 2382
  Description of Unknown: Bacterium polynucleotide
  Phylum: Proteobacteria; Class: Gammaproteobacteria; Order: Enterobacteriales; Family: Enterobacteriaceae

SEQ ID NO: 2563 - DNA, 252 bp, Paenibacillus sp.
  Phylum: Firmicutes; Class: Bacilli; Order: Bacillales; Family: Paenibacillaceae
tacgtagggggcaagcgttgtccggaattattgggcgtaaagcgcgcgcaggcggtcatttaagtctggtgtttaaaccttgggctcaacctggggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacagg

SEQ ID NO: 2564 - DNA, 253 bp, Sphingomonas sp.; identical to SEQ ID NO: 2336
  Phylum: Proteobacteria; Class: Alphaproteobacteria; Order: Sphingomonadales; Family: Sphingomonadaceae

SEQ ID NO: 2565 - DNA, 20 bp, Unknown
  Description of Unknown: oligonucleotide
atccgtggccgacgtcgtgc

SEQ ID NO: 2566 - DNA, 23 bp, Unknown
  Description of Unknown: oligonucleotide
gcaacacgtttcggtgccggtgt

SEQ ID NO: 2567 - DNA, 20 bp, Unknown
  Description of Unknown: oligonucleotide
ttgtcgactttcgtttcacc

SEQ ID NO: 2568 - DNA, 21 bp, Unknown
  Description of Unknown: oligonucleotide
  B.phyt23S
ctctcctaccatgcacataaa

SEQ ID NO: 2569 - DNA, 18 bp, Unknown
  Description of Unknown: oligonucleotide
  EUB338I
gctgcctcccgtaggagt

SEQ ID NO: 2570 - DNA, 18 bp, Unknown
  Description of Unknown: oligonucleotide
  EUB338II
gcagccacccgtaggtgt

SEQ ID NO: 2571 - DNA, 18 bp, Unknown
  Description of Unknown: oligonucleotide
  EUB338III
gctgccacccgtaggtgt

SEQ ID NO: 2572 - DNA, 20 bp, Unknown
  Description of Unknown: oligonucleotide
  pHr
tgcggctggatcacctcctt

SEQ ID NO: 2573 - DNA, 18 bp, Unknown
  Description of Unknown: oligonucleotide
  P23SR01
ggctgcttctaagccaac

SEQ ID NO: 2574 - DNA, 18 bp, Unknown
  Description of Unknown: oligonucleotide
  M13f
tgtaaaacgacggccagt

SEQ ID NO: 2575 - DNA, 19 bp, Unknown
  Description of Unknown: oligonucleotide
  M13r
ggaaacagctatgaccatg

SEQ ID NO: 2576 - DNA, 19 bp, Unknown
  Description of Unknown: oligonucleotide
  1824 Forward
aaaaacgagccaaaagggc

SEQ ID NO: 2577 - DNA, 18 bp, Unknown
  Description of Unknown: oligonucleotide
  1824 Reverse
cgttatttcgcgctggtg

SEQ ID NO: 2578 - DNA, 20 bp, Unknown
  Description of Unknown: oligonucleotide
aaacctcgtacctcgccagc

The invention claimed is:

1. A method of producing a substance selected from the group consisting of a Hydroquinone glucosyltransferase, a Replication factor C subunit 3, a NEDD8-activating enzyme El catalytic subunit, and a Delta3,5-delta2, 4-dienoyl-CoA isomerase within a bacterial colonized cereal plant bioreactor, the method comprising:

a) germinating a cereal seed into which at least one inoculant bacterial endophyte has been introduced, wherein the bacterial endophyte is from the genus *Burkholderia*, comprises a 16S rRNA nucleic acid sequence comprising SEQ ID NO: 1446 and can grow on nitrogen free media, to produce the bacterial colonized cereal plant bioreactor; and b) growing the bacterial colonized cereal plant bioreactor under conditions such that the bacterial endophyte proliferates and the substance is produced in the bacterial colonized cereal plant bioreactor, wherein the substance is produced at a higher concentration in the bacterial colonized cereal plant bioreactor compared to an isoline plant grown from a non-inoculated cereal seed; wherein the substance improves symbiosis.

2. The method of claim 1, wherein the at least one inoculant bacterial endophyte is introduced into the cereal seed by the method of: contacting at least one flower of a cereal plant in the course of a flowering phase of the cereal plant with a preparation comprising a population of the at least one inoculant bacterial endophyte, wherein the preparation comprises $10^6$ to $10^9$ CFU per ml, whereby the inoculant bacterial endophytes enter the flowering plant via at least one flower and are conveyed to an interior of at least one seed produced by the flowering plant.

3. The method of claim 1, wherein the cereal plant is corn.

4. The method of claim 1, wherein the cereal plant is wheat.

5. The method of claim 1, wherein the substance is the Hydroquinone glucosyltransferase.

6. The method of claim 1, wherein the substance is the Replication factor C subunit 3.

7. The method of claim 1, wherein the substance is the NEDD8-activating enzyme El catalytic subunit.

8. The method of claim 1, wherein the substance is the Delta3,5-delta2, 4-dienoyl-CoA isomerase.

9. The method of claim 2, wherein the substance is the Hydroquinone glucosyltransferase.

10. The method of claim 2, wherein the substance is the Replication factor C subunit 3.

11. The method of claim 2, wherein the substance is the NEDD8-activating enzyme El catalytic subunit.

12. The method of claim 2, wherein the substance is the Delta3,5-delta2, 4-dienoyl-CoA isomerase.

* * * * *